United States Patent 7,745,391 (HUMAN THROMBOSPONDIN POLYPEPTIDE) - sequence listing, part 103

SEQ ID NO: 315156 - DNA, 3073 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttgtaagtgaaaaaattatctttgattgtttggtaggagtttatcttagagtactgtacataaggaaggtcatatacatgatttagagattgttatgtgtgtcattattcctaaagtcagagatagtattgaaacatgaagtggtgtttgaagtgctgtcttcatttagaaatgccattttgaggtctagaagcatctgtataaactaggtacttttcttgacttcgagatcaataactgtacctagtccttaaagaccaagagtcaaggaaagttactgatttgtaataacatttctttaatcacttagtttttgaaaaggtacctttagcgcagaataaatccaccacgttgttatcccagtcaccatagtacagctgttccctgtgtaaaagtcgccaggtc

SEQ ID NO: 315157 - DNA, 2415 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacagttgtcactgaggacacaggaaggaccacgactacgcaatcgagctcggagaccccccaacaccgcgcgcagagggagagggatacgcggataagggtgaggctaacgcggatgtaagggtgagggaagacgcggttaggctgaggttcacgcggacagggtgagcgctcacgcgggttagagtg

SEQ ID NO: 315158 - DNA, 1655 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggtaaaaactaaaatacagaatctagattataatattgtttttgttctttgaattctgtttggaattataaacgtaaaattgtgatatgtatttaactagcggtttttactcttgacttccttcattttaagataattccaaattgtttttactcttatctggtgaactttggaagctaagtgttttaataaaaattaatttatccagctactcaggaggctgaggcgggaggatctcttgagcccaggagttcaaggctgtggtgagctatgattgcgcctactgcactccagcctgggcgatagagcaagaccctgtctctttaaaaagaattaaaaaaacctaatttctatccctcctcttaat

SEQ ID NO: 315159 - DNA, 1949 bp, Homo sapiens
taatttcttttcaaactcaaaagatctcaacgctatcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgttttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccctaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctccagaatagtg

SEQ ID NO: 315160 - DNA, 923 bp, Homo sapiens
tgtacaaactgcagtcattttgaaacttggccttaagaacatccttactttttcctactcttctcttcctttcattaaagtaataaaagacataacttaatttaaaaatactaaagaactgaaccttattcttgacctttacagactactattttctaactggcaggccctagcatgtttttcattattgatgtaaaacacatattgaaggagaatggaaacagactgtgtcaaagtttaacacccaattattttatttacataattttattaggggatagtgttgttgacttgaaaaatatctcttctgttgtaagattcagcagggtctttatctttttaaaagtatcacattttttgttttctttattttgcagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttgtaagtgaaaaaattatctttgattgtttggtaggagtttatcttagagtactgtacataaggaaggtcatatacatgatttagagattgttatgtgtgtcattattcctaaagtcagagatagtattgaaacatgaagtggtgtttgaagtgctgtcttcatttagaaatgccattttgaggtctagaagcatctgtataaactaggtacttttcttgacttcgagatcaataactgtacctagtccttaaagaccaagagtcaaggaaagttactgatttgtaataacatttctttaatcacttagtttttgaaaaggtaccttaacgccttaataaaacccctgtatgttcatctctgtattaca

SEQ ID NO: 315161 - DNA, 5435 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315162 - DNA, 5853 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacaggtaattgttcaaactgactaagataggttttagcttctaattagcctttaataattgtcagcttaattgctttcaattttgactgtgtaatcgaatgtttaaatttaaacaattaaaattatttgttttacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315163 - DNA, 7135 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgttttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccctaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctccagaatagtg

SEQ ID NO: 315164 - DNA, 4997 bp, Homo sapiens
ggtatttctcactgactaatgacatttgaaacagatacattgtttaaattctgatttcaagtgttgctgaaagttgctaacagtgaaaattggttgcttcatgtattgtgatttgacttaaaagtgagaaaatagaggaaacatgctgtttgtggaatagcactgcacaatctagaatttatgattgaactgatcattagtttctatgaaatagtgccagaaatcattatttttctagagcaagtttatatgaactgttctgtgattttcataaagtattaaattactgcagtggtaattaaatccatttgtgtgaactcttgtttatattaatagataatatctggaattttggggataattatcaatagaattctaacaatgtattatctattagtggttcttagtttcaaaaattaaatttaggcaatctctagaagttcgtgttagtgcagaattgtggattgtgactaaataggacaggtttttgtgattggctttgtgttttaaacttcagaagtcaaatgtaaatttattttaaaagtcagtacataagttctatatggatgctttcaatgatttttaaaagtggaatctgaaaaagcacttttcaatagggttattttctctcttgctggtcctgagggattgggcaacacatttaaatatggaagcgatctacagtgaatgcaatccagagttactatcctcttctttgcttattcgcaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315165 - DNA, 4463 bp, Homo sapiens
ctctcgccaaaaaaactaaaagggggttataaaaaaggtttgttgtctgccattactctgccaacattctgctctccccgcgggggataattctctttggagaggtgaagctgaatagtggggaacctgttccaaaagggtaccagccagaggcccccccaaaaggggtttttcccaacgcttggaaaaaggggggccccaactttaatggaagtgaaaaaacggttggaattggggaattttttaaaaggaaagacagaaggcgatactacagataaagtttgtgttgagaagcccttttaaaaaggaggtaccctgggaaataaatgcggttaagagctggggaaaaaaaggggccccttatagctcaaccgttaccctcaagatggagttatacgtcctccctcatagggtaaaggattatggcccctcaggaaaggtgttcttggaaaaaggagaattataacccaggtgtatataggtatatgaaaacctctcacgtgcacctctcgtaggtccacgggttaaaaagttgtctcgagaaaaagggcttccacaaaggagcctctctctcttggagagtttaaccacggtgtcccccccgctctctatacacccacaggagaattctggagaatgccaccgaggagaagaggtgctaacctcttcacgagagagggaaaatgccccaccttaaggagtccacaaaattgagtatggcgagagtgaattttctcacccgcttccctgagaagctcacaaactcacaaaatgggcaccctgtttccttcttgaatgaatttctaaccaagagacctggcttcccttgacctataaaacacacggctggcttggctagtaacacacttgtccacattctgtccaaagaaagggaggcaaagaaattctcgaatccaatctttgagccaccaattaaagttgccacacacaggccacgcacaaaagcacactttcaagagagtcaatttaattcaaacaccacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315166 - DNA, 3530 bp, Homo sapiens
aaatatctggttggagcattttaattcattctttgtgggtattttttcttaattgtgtattataaactaaattaatagtcttggtgtgctaaattagttgattgggagagaaataactgtcttaggaaaatggataatcgtgtggatgtttttgaaccaaaaagttaataatatgactaaaaatatattttattttacattaaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315167 - DNA, 2820 bp, Homo sapiens
  misc_feature (33)..(34): n is a, c, g, or t
  misc_feature (74)..(74): n is a, c, g, or t
  misc_feature (77)..(77): n is a, c, g, or t
tatatttcttcctgttccagtcgttcccactcnnttttatcccctttttttatttctccacataggacgacagnatnagtcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315168 - DNA, 2798 bp, Homo sapiens
  misc_feature (24)..(24): n is a, c, g, or t
aatgtgaggtttaaattgatggcnaaaataaaaaacaacagcactcacatgtacacgtcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaa

SEQ ID NO: 315169 - DNA, 3038 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttgtaagtgaaaaaattatctttgattgtttggtaggagtttatcttagagtactgtacataaggaaggtcatatacatgatttagagattgttatgtgtgtcattattcctaaagtcagagatagtattgaaacatgaagtggtgtttgaagtgctgtcttcatttagaaatgccattttgaggtctagaagcatctgtataaactaggtacttttcttgacttcgagatcaataactgtacctagtccttaaagaccaagagtcaaggaaagttactgatttgtaataacatttctttaatcacttagtttttgaaaaggtaccttaacgccttaataaaacccctgtatgttcatctctgtattaca

SEQ ID NO: 315170 - DNA, 2299 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacagcctcgcctcgcctttccctcagttgcttcagggggtatggagattaaccatagagagattcagtctct

SEQ ID NO: 315171 - DNA, 1404 bp, Homo sapiens
tagcggcacccgaggccacgccccgagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaagtcacagatgaagagtctagagtattttttgcagagtgaactgtactgagcatgggagcatcagagcaagatgaactctgactaggtggtgtagcaataggtgaaggactatgggg

SEQ ID NO: 315172 - DNA, 348 bp, Homo sapiens
gaccttttggtgctgagcgcatgagtgacagaggcagagatgctgctgcaactggaagaagctggaaccagtcccagagaggctcggcctggaaacagtcccctgcccagagtcccctcagcctccatgacaggtccctccctggccccccaaccctcttcctcccttgccccaaccctgagaaagggtccagccactaccctgttggcaaacattcccttccatggtcagcctgccaggaggaggggagtcaccttggggctggaggcctctcagaccccatcctgacagcaggttgagtattcccactttcaataaaagactccactttcccggcacttgtgacga

SEQ ID NO: 315173 - DNA, 108 bp, Homo sapiens
tttgtagatatttgaaaagtagagccattgggactttctgatggatgggatatggggtatgtgagaaagagaagggttgagaatgactccaagatttctagtctgcag

SEQ ID NO: 315174 - DNA, 405 bp, Homo sapiens
gccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctaggtaaggcgggccaacccaggtctcggaaggaagggggcggggcaggacggggcgggaggggccgcgcagtagctgggctgtgaggacggttggcgagttcattccgggctcgggtcgggaagtgtccgcccctggagtcaagctggggagggtgagaggttgaagggcaatgacttaggttcccagcttctggccctgccaggctctgcagtagcccaagcccaccgctgcccgg

SEQ ID NO: 315175 - DNA, 3284 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaaaaaaaaaaaaaaaagggcggccgctcttttttttttttttttttttccttcagagcagtgattcctaggtatgagaaagctaagagtttcaaagtgctttagagttatttcttttttaaaaatgttaagaaaatcttgaaaaaataattcaaagacattttcaccaaccttccaattgagagcagtccccaaggttcaggtctttt

SEQ ID NO: 315176 - DNA, 3145 bp, Homo sapiens
gccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315177 - DNA, 3009 bp, Homo sapiens
cccgctctagctcgcgtctcccgactccaattagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315178 - DNA, 3107 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315179 - DNA, 3306 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaattccaaacccgtgtgtgtgcctttttaaaaacccaaatgtgaatttctatataaagcatactcggggtacattaacaaaagttggatgatatgataagggagacatgtgttaaaatgattgctattaaaatacttaaatatatataggcgattataaatgacaaacacacacaagttaatattatcacacataaaaagataagagttgaagaacatttatagttaaaatgggccacatgaaagggacaatttacaaaatgggagaaaaatttatatacaatctgtgagaaaacatatataatatatagatagaaaagttgcacaatagatatttatcacacacagaattgaaacaaaaagatgagcaacgaattgtaaaaacttataagtgtattacaaaaataaaagttacaagagaaaagacaatgtatataaataataaggaataggataatgaatggacatctttaccaccaaatttctaaaagtgtaaagaatcgtgaggcataataaccaatattaaaagggaccaattacaaatataagaagtgcataaaagtgttgagcactttaaacaagtagggatgtgtaaaaatatttaaaaaacaagagtattaacgtgtggaacaaataagatatataaaagaaccaattagaacacaaatatgataaatatattaaacacttgataaacaatatcgggagcgaatacatatacacattataataaagtcaccccttaacaactttcttcac

SEQ ID NO: 315180 - DNA, 1224 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315181 - DNA, 1019 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcgcatgaacatcacactccactgaagacgtacaacggtggaaatcttgccacaccacgatatcttacgagagagcgcaggcaaccggacctacaatggtccagctgcagaaggggaggcagcaaaaggcacgcacggcacaagtccggcattgcagcgtgggaacacagccgcacatccgggcccaaagcacaacgagaccagacggggcaaccatgaagcacacgcaaaccttcctgacaa

SEQ ID NO: 315182 - DNA, 3150 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315183 - DNA, 3252 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315184 - DNA, 2678 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaactttagagcacactggggtaccggat

SEQ ID NO: 315185 - DNA, 2297 bp, Homo sapiens
gcgtcgacgtaagtgacgcgcaagcctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315186 - DNA, 2289 bp, Homo sapiens
tcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacagttctggatgctaagaagttcactgttatgaggccacatctggtgagagccctgccagtggcgactctgcagagtcctgaggccatgcagggcatcacatggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaaatccacacccatgtgccttctcaaaaccaactgaacttctataaagcatctctggttctttcaaagtttgtgttgtaaggagcaatgtagatgatgctataatactttatatttttgcttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatg

SEQ ID NO: 315187 - DNA, 2614 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315188 - DNA, 711 bp, Homo sapiens
atttcggattttaattcgactccccaatagggaatttgggcccttcagggccaagaattcgggcacgaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315189 - DNA, 515 bp, Homo sapiens
ccatgctcatagctgactctagaggataaaattcctctcatcgaaccttaattcgtggcgagagctgttcccggagaagaaaaccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggtaaattctacctgtggttgtggtcatttatttcgtgtctttctctccttccctcctggtggctcccaaggctcattcgtggagaggagtgtggctggattctagtctgaaagttgaatggaaatggatagcctaaattgtggatttttcatagccggggtccccccacaccaaaggagtggttccttagaatcctggagaattcttgagtagacgggaggaaaggagtgat

SEQ ID NO: 315190 - DNA, 4297 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataaaaaaacctgc

SEQ ID NO: 315191 - DNA, 4243 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataaaaaaacctgc

SEQ ID NO: 315192 - DNA, 3103 bp, Homo sapiens
  misc_feature (2663)..(2663): n is a, c, g, or t
  misc_feature (2667)..(2667): n is a, c, g, or t
  misc_feature (2670)..(2670): n is a, c, g, or t
  misc_feature (2677)..(2677): n is a, c, g, or t
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaacaaaaaaaaaaaaaacaaagaaagaaaaacacacaacaaacnaaancancaaacanaaggggggggcgcgcgccgcaaataaattcctcccggagggggcgccccaaatagggcgacccccacagcttttttgtaaaacagggggcgcgccccataagggggacgcgtctatataaacagcgggcggcggggggcgcgcggagtgtaaaaaaacagcgcctcgggagcgggggcaaaaaacgatgggctatgaggcgggaacctactgtgagagagaggaacaccccccaaacttcgcggggggggagcacaacatattgggggccacactcaccccacgacaggaagaattaagagccctctggggggaaacaatcaaaacacctcggagcaggtcatttcacagcggggggtccaaaacgacaaccgcgcggaataatccgcgccgccgcagagaagaacatcttgtgccacaccgagat

SEQ ID NO: 315193 - DNA, 2683 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaaacactggcgtcgtttacacgttgtgactgtctttgcggtacccctttcgcttgtggtttcc

SEQ ID NO: 315194 - DNA, 2954 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaacaaaaaaaaaaaaaacaaactctcacaaaaaaattaaaactacaacaaaaatatctaactatctatcatcaactaactactaaaaacgcttctccctacaaacaacccatcttttaacatccttctgctgcccgtctcgtcctctctcttttttatctctgacaccattttttttccccctccttattccccgtctctttcccaaccctcccactaaccacccgctcaccataacctcgcccgcgttcttacaaaactcttggcctgaacctccgtcttaccccaattaatcgcctctccacccaaacccctcttttcctaactgggctatcc

SEQ ID NO: 315195 - DNA, 2292 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315196 - DNA, 2217 bp, Homo sapiens
ccagctctggctctgtgccttcttccaaagggcgtttgctgtgtcaactagtccctggcaccttttttcccccaagcccccgataaagcgagggctggcatggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315197 - DNA, 2708 bp, Homo sapiens
  misc_feature (2632)..(2632): n is a, c, g, or t
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaacatctcctcgataacagaggaaagtatggggaaggagccagcaggagacgttcacctttgccttaactttggtcttcattcantgtgtgatcatgcctgtgtttgccagatctgtggatcgtacccggagctggctctatgctgcctagttctatctca

SEQ ID NO: 315198 - DNA, 1852 bp, Homo sapiens
cggcacgaggcgaagaacttttctcccccgtttgtttgttggagtggtgccaggtactggttttggagaacttgtctacaaccagggattgattttaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315199 - DNA, 2574 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccagtttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315200 - DNA, 1600 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315201 - DNA, 600 bp, Homo sapiens
  misc_feature (33)..(33): n is a, c, g, or t
  misc_feature (37)..(37): n is a, c, g, or t
ggactctagagagatcccgttcatgtttctacncaanccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315202 - DNA, 2329 bp, Homo sapiens
aaaagaacaggataacagcaattgttcagggaataagagagataaccttaaactctgaccaacagtgagcctggtggaacagagtcatatttctcttctttcaaaagcaaatgggagaaatatcgctgaattctttttctcagcaaggaacatccctgagaaagagaatgcacccctgagggtgggtctataaatggcctccttgggtgtggccatcttctatggtcgagactgtagggatgaaataaaccccagtctcccatagcgctcccaggcttattaggaagaggaaattcccgcctaataaattttggtcagaccggttgcttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataaaaaaacctgc

SEQ ID NO: 315203 - DNA, 1972 bp, Homo sapiens
  misc_feature (41)..(41): n is a, c, g, or t
gagagagagagagagagagagagagagagagagagagaganagagagagagcagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataaaaaaacctgc

SEQ ID NO: 315204 - DNA, 1015 bp, Homo sapiens
ctaaactgattgaaatttaaggtcctttgaaggaaaagatatccagttatcgggtggcaaagagcagaggaggtaaactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataaaaaaacctgc

SEQ ID NO: 315205 - DNA, 1927 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315206 - DNA, 4147 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcctttttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacag

SEQ ID NO: 315207 - DNA, 2756 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaaaaaaaaaaaaaaactcgaggggggggcccgtacccaattcgccccattatggagtcgtatttacgcccccctcacttggccggcgtttttacaaacgttcctgaactggggaaaaaaccctgggcgttaccccaaat

SEQ ID NO: 315208 - DNA, 2491 bp, Homo sapiens
tagacagctacctaaagcctgaaagactgacagcaacacagaaaaaaagaaacaggcagaaagagagacaagaaatcaagacaccaggcagcaggacacacacacactcacatacactcacacacatagagaccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315209 - DNA, 3125 bp, Homo sapiens
  misc_feature (2685)..(2685): n is a, c, g, or t
  misc_feature (2689)..(2689): n is a, c, g, or t
  misc_feature (2692)..(2692): n is a, c, g, or t
  misc_feature (2699)..(2699): n is a, c, g, or t
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtaagctccaaaaacaaacaaaacacaacaaaaaaaaaaaaaacaaagaaagaaaaacacacaacaaacnaaancancaaacanaaggggggggcgcgcgccgcaaataaattcctcccggagggggcgccccaaatagggcgacccccacagcttttttgtaaaacagggggcgcgccccataagggggacgcgtctatataaacagcgggcggcggggggcgcgcggagtgtaaaaaaacagcgcctcgggagcgggggcaaaaaacgatgggctatgaggcgggaacctactgtgagagagaggaacaccccccaaacttcgcggggggggagcacaacatattgggggccacactcaccccacgacaggaagaattaagagccctctggggggaaacaatcaaaacacctcggagcaggtcatttcacagcggggggtccaaaacgacaaccgcgcggaataatccgcgccgccgcagagaagaacatcttgtgccacaccgagat

SEQ ID NO: 315210 - DNA, 2527 bp, Homo sapiens
ccagctctggctctgtgccttcttccaaagggcgtttgctgtgtcaactagtccctggcaccttttttcccccaagcccccgataaagcgagggctggcatggttagcctttgcttgctacgtttcggacttcgtctttagggcacttgctgaatggctgggaggccattgccgtacttgggggctacagttgtgttttgggggggtctccaggcagcggtgcccatttcctcgttcgtggggctctcttctgggcatccacccgcgcctccctccccacaacggcgggggtggggtctcgatggccacaggggccttagggggaagcggggcactcccggtccagggctgggggcgggaatggcggcgccccggccgcttcagtgacgctcccgctttctctgccccttaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315211 - DNA, 1942 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315212 - DNA, 2861 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaacctaattttctgtgagcacactaaaagcgaaaaatacatgtgactaccatgtccacaaaaaccaccaacaacaacacccaacgcaccgcaacacaccgcaccccccacaccccaacaacacagacgcacgccaccaaaaccacccagggcggcagccccgcgccacacaccatcccacacccccccccacaccggaacccccccacaccccccaacacgcctacacacccacagcgcaaaccgccccccacccgcgcacacccccccgggggaccctcccgccacacccgcccccgccccccgcaaacaaga

SEQ ID NO: 315213 - DNA, 2266 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaataagatcctgaaggcatattccttttgggccgcttggcccattcgactttaaactcgagcaagtttttcatgcgggccgaatttgaggctaattggccaatttgccctataaggaggggttttacaattaaatggcccgtgttttaaaacgtcgggaacgggaaaacccttgggttacccaacttaatgccttttgagcaccccctttcccccactggggtaataacaggccctgccctggccctttc

SEQ ID NO: 315214 - DNA, 1582 bp, Homo sapiens
ttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaa

SEQ ID NO: 315215 - DNA, 729 bp, Homo sapiens
  misc_feature (708)..(708): n is a, c, g, or t
ctcggcctcccaaagtgctgggattacgggtgtgagccactgcgcccagctatccagtattttatttaaaagttgtcactagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatggtttaaaaaaaataagtgctgggattacgggtgtgagccactgcgcccagctatccagtattttatttaaaagttgtcactagggtgttcactattgtgaatttataatcttaaaagttggggatgctaaaagtaccagactaaaatactacgaggttttctcatcttttaatnccattttgttagaaaaaaaaa

SEQ ID NO: 315216 - DNA, 630 bp, Homo sapiens
ctcggcctcccaaagtgctgggattacgggtgtgagccactgcgcccagctatccagtattttatttaaaagttgtcactagggtgttcactattgtgaatttataatcttaaaagttggggatgctaaaagtaccagactaaaatactacgaggttttctcatcttttaattccattttgttagaaaaaaataatcacaaccggggttcttttacctttccccagccatctagactgctttactgcaatgttgggaagattgcatacaataaaaactgtagctagttgattgggatttgggaaaattgaatcaagcatttgcattcatccagaatggtcttaaactgctgactgtggggtgcccacaggatgagcactggtggcatgggtgggaggaatttccttggatactgcaattgcatttgaaagatctattttccaaaacctgagcagagagaggctaggaggaatgcagacaggacattgaaaatgcgaattccctttactagtagaacatgaaatatctgataatggtttaaaaaaaataagtgctgggattacaggtgggagccacaacacccggccatgaattaactccgttaaaaaataaacgtatacattctgtgagc

SEQ ID NO: 315217 - DNA, 1179 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaatttta

SEQ ID NO: 315218 - DNA, 1548 bp, Homo sapiens
  misc_feature (1191)..(1192): n is a, c, g, or t
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaattttaaaaaaaaaaaannaaaaaaaaaaaaaaaaaaaaaaaaaaaaagggggggggggttaaaaattccccgccgaggggggcgcccaagttataaggctggaacccaaggtttttgcgacaaggggggccctataagggaaaagggagattaaaaacgtagaggcacgggacggggtgttaaacaagttgttgtgatgtgggccaaactgggacagctgggagacctttggagaggcgaccctacctcgtggggggtgggcaatacggggccaccaaccaacaggagataaagcgctcagggaattataaactttagtgttagtggtacaacgggatatgctgcgtcgaagttggtacgggtgtttgaactta

SEQ ID NO: 315219 - DNA, 1300 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatggggggtgtcatggatgtcctgggggtgctatagggaaggaaggagggaggccagcgttcagccctgcctgagagggttgctccctgtgtaagtggtcactgtcatcacctctctcccacagggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaatttta

SEQ ID NO: 315220 - DNA, 1184 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatggggggtgtcatggatgtcctgggggtgctatagggaaggaaggagggaggccagcgttcagccctgcctgagagggttgctccctgtgtaagtggtcactgtcatcacctctctcccacagggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaac

SEQ ID NO: 315221 - DNA, 1023 bp, Homo sapiens
ggtcagttgagagctctatggatcgtgacagagcttaccagatgcacagtatagggccggtgtactcctgctgttctcgcatgttgcgccggcgcgtgtgccgacatcgcgttgccctttcgccgtcctggtgcgtcgattgagtgcgggcatggggtccccgctgtctgggctcccattggtctatcgccagtactattattagtcctccatgcactcggccttggcgagagtctggatggctgctgaaatgtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaac

SEQ ID NO: 315222 - DNA, 1009 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaagggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaatttta

SEQ ID NO: 315223 - DNA, 561 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcgcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaatttta

SEQ ID NO: 315224 - DNA, 850 bp, Homo sapiens
  misc_feature (493)..(494): n is a, c, g, or t
ctgcaggacttggatactgattatggctcaggctacccggtggttagtgctgccagcatctgtgccagtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaacaaaaaaaaaaannaaaaaaaaaaaaaaaaaaaaaaaaaaaaagggggggggggttaaaaattccccgccgaggggggcgcccaagttataaggctggaacccaaggtttttgcgacaaggggggccctataagggaaaagggagattaaaaacgtagaggcacgggacggggtgttaaacaagttgttgtgatgtgggccaaactgggacagctgggagacctttggagaggcgaccctacctcgtggggggtgggcaatacggggccaccaaccaacaggagataaagcgctcagggaattataaactttagtgttagtggtacaacgggatatgctgcgtcgaagttggtacgggtgtttgaactta

SEQ ID NO: 315225 - DNA, 1063 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaac

SEQ ID NO: 315226 - DNA, 1132 bp, Homo sapiens
  misc_feature (1076)..(1076): n is a, c, g, or t
  misc_feature (1078)..(1078): n is a, c, g, or t
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacaaaaaaaaananacaaacaaagagacacaacacacaaaacacacacaaaaaccaaacaaaaggggg

SEQ ID NO: 315227 - DNA, 1163 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgatccccacgtccggtctagtattattcatctagacttataatacatagttgtc

SEQ ID NO: 315228 - DNA, 998 bp, Homo sapiens
gcgggaaacgggagtcgggattgcactgcaccaagggaggggatgtggtcgtggtgatggcacctaaagaagcagtgatgatagaacagggatgaatggcaactttcacgggctcagtgattggaccccggctgccagaaaactgacaccccttctccccaggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaac

SEQ ID NO: 315229 - DNA, 761 bp, Homo sapiens
cagaccgtacttggagagcgaccggcaccgcagtcccgggaaaacttggcagccgccgcgcctcgtatgtctctagcatccctactggtctccacgtatacctggctgacgttcacgccctggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaac

SEQ ID NO: 315230 - DNA, 962 bp, Homo sapiens
ggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtgagttaactgtaagttgtccccatttggtcatctcaggataaaatggggacaaaacaggagttcgagactgcagtgagccatgatcatgccacagcactccatcctgggtgacaaaggaagccccccaactcaaaaatggaggcagggcgcagtggctcacgcctataatcgcagcactttgggaagccgcggcgggtagatcaccggaggtcaagagttcgagaccagcctgaccaacatggtgaaaccccgtctctactaaaaatacaaaaattagctggacgtggtggcaggcgcctgtaatcctagctactcaggaggctgagacaggagaatcgcttgaacccaggaggcagaagttgcagtgagccaagattgtgccattgcactccaacccgggcaacagagcaagaccctgtctcaaaaaaataaaaaataaaaaataaac

SEQ ID NO: 315231 - DNA, 741 bp, Homo sapiens
cggtaaccgcgtcgcagtcgccgaagatggcggggcgaagtctgtgtctcacgagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315232 - DNA, 842 bp, Homo sapiens
cggtaaccgcgtcgcagtcgccgaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315233 - DNA, 807 bp, Homo sapiens
ggccagggaagcgcgccgctgggggccgggaggagtccggcccggctggtggagagcaggaaaacgtgggggaggtgctggcgagagaaagagaacttgcgtgaggaggaggaggagaaaccaaatttaataatatttggcgtggaaatgggatttgggcgggggaggcatcttcaaagcaagtaaagagaaatcaacattatcccccttcccctgcacatgcatgtgaggattacttcctccctgagtaaatgaagagaactgaagcaggcgtttaaatgcagaattgcaggcaaaaacagctgacgtggttcaacaagctaaggaaataatatttttgccagtgtctgaaaagcaggaaaatacttgtacaaaaggaccccacgttatagtagaatgacagattcattacgttttctactcagagagccctgtaaaaagaatctccccctgcaaataaaaaacagaatagaaaactgggataagctaggaaaggggttggggaatggattcctacccctgcagaagcaaacaatataaggtttctcatatttaatttttatttactcactttctctttttaaaatttttaatgtttgtggttacatagtaagtgtttatggggtaaatgagatattttgatacaggcatgcattgtgtaataatcacatcatggaaaatggggtatccatcccctcaagtatttatcctttgtgttacaaaaaatccaattatactattttagttaatttaaaatgtacaattaaatgattttgactataataaacatgttgtgctgtcaaaaaa

SEQ ID NO: 315234 - DNA, 866 bp, Homo sapiens
ggccagggaagcgcgccgctgggggccgggaggagtccggcccggctggtggagagcaggaaaacgtgggggaggtgctggcgagagaaagagaacttgcgtgaggaggaggaggagaaaccaaatttaataatatttggcgtggaaatgggatttgggcgggggaggcatcttcaaagcaagtaaagagaaatcaacattatcccccttcccctgcacatgcatgtgaggattacttcctccctgagtaaatgaagagaactgaagcaggcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315235 - DNA, 663 bp, Homo sapiens
cctccttatgctcaccccatccgtatgctcatccctcctatatgctcatccctccttacttgaatttcttggttttggtgttatctaggtcttttccagctatacagttgtgatattcttgaaaacacatttttggtaattccatgaaaatagcaaatagcagtttttctgtgtagcaaaattctatgtgttacagaattgctttctttggcaaatgattagactctaattagtcaatactttcaattcttttcatgtagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315236 - DNA, 557 bp, Homo sapiens
  misc_feature (10)..(10): n is a, c, g, or t
  misc_feature (96)..(96): n is a, c, g, or t
atgcgccacnatgcctggctaatttttgtatttttagtggaaacggggtttcgccgtgttgcccagactggtctcaaactcctgacctcaggtganccaccacctaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315237 - DNA, 964 bp, Homo sapiens
cggtaaccgcgtcgcagtcgccgaagatggcggggcgaagtctgtgtctcacgagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315238 - DNA, 853 bp, Homo sapiens
cggtaaccgcgtcgcagtcgccgaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataatatgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagac

SEQ ID NO: 315239 - DNA, 342 bp, Homo sapiens
atcagcaatagaatccacattttctttctctcttcctcagtctaccttcctaaaatctagctaacctgtgtatcttgttctatctatcactaaatataggtatttactaaaaagttttaagggtataggggagtaatagggatatagctaaaaggagattggccctatgacttgacaatggttcaagctgagcaatgggcacacagaatttattatctcattctatttcagtatatatttgaaattttccataataaaagttttttaaattacttatctttaaaaggtccttatgtattttccatgaggcaaaatgaataatgtatgtaacaacttcagtat

SEQ ID NO: 315240 - DNA, 780 bp, Homo sapiens
ggcagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctagggtacaaacggaacggcggcgttttccttgtatcatttagaggaaatttttgagctgaacagtattttttttctccctctctctctctctgaaatattgctgagatttaaaggaggacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcttaaaccgagttcctgggctccctcactggcttcgtccacttaaacttttaacgtacacatgtagagagctgaaactccaggggtaacatgggacaggtcctcttgatttaatgaaaacagaagatcaactggaccgggtagcaagaaataaggcttaagaagcactggtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgcta

SEQ ID NO: 315241 - DNA, 345 bp, Homo sapiens
ggcagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctaggtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgcta

SEQ ID NO: 315242 - DNA, 1511 bp, Homo sapiens
  misc_feature (1123)..(1123): n is a, c, g, or t
  misc_feature (1149)..(1149): n is a, c, g, or t
  misc_feature (1195)..(1195): n is a, c, g, or t
  misc_feature (1219)..(1219): n is a, c, g, or t
caattatttcaaaatatttggaaagtttaggaaatagaaaaaaaggcaaaaatccctttattccccttctcttgttgatattttagtctatttccttttggtctttttttaatacagaagttgtgctattgttgtcattttctttggttgtaatcaaaagcatacagagttttgcatcctgctttgtttagataatgttataactatagtattttccaagtttttaaaataaaatcttcataatttttatcatagtgcaatacagttgacccttggacaacatggattggaaccgtgcaggtctactaactaatacacagattctcttccacctatgccacccttgagacagcaagaccaacccctcctcttcctcctccttttcagtccactcaatgtgaagacaaggaaaatgaagaactttatgatgatccatgctattagtctgttctcacaccgctaataaagacatacccgagactgggtaatttataaaagaaagaggtttaatggactcacagttctacatggctgcggaagccccacaatcatgatggaaagcaaaggaggagcaaagtcacgtctcacatggtagcaggcaagagagcatgtgtgggggaacttccctttataaaaccaacagatctcgtgagacctattcactatcacaagaacagcatgggaaaacccaccctcatgattcgattaccttccaccaattccctcccactatacgtggagattattacaattcaaggtgagatttgggtggggacacaaagccaaaccatgtcaatctatttccacttaatgaagagtaaatatatttctcttccttatgattttcttaataacattttcttctctctagcttactttattgtaaaagtatagtacatgatacatgtaacatacaaaatatatgtgaatcaactgttgatgttattggtaaggcttccagtcaacagcaggctattaatagttaagttttgggggagtcaaaaggtcaactgaatttcattgtatgattgtagcacattacatctatcatttttaactgtatatttttctttctaaataatttttaagctttttctttgagtattttttagtgagtcttcantagaatgtaggagtatcttcctattntctatattttactcctttaaatctgcttacttgttttaaatagtcncttgctataaatcttttaaattcntatgagattaaatatttccacttaagatgcaatggaacttactaaaaaagtgctaaaaagtaactatactgaggctgtgatcagtctctgagacccagttcctattgctaacagtactttggtttttggaggctgtcctcctacaactgagaaaagtaatctattaccaatatttaaagtattttccctattggtgctttgtttaaactttcttagagtttgtagtaacaaaagtgacatgttttaacaagtcaaacaacatagaaacacttaagaaaatctaataatctgc

SEQ ID NO: 315243 - DNA, 2957 bp, Homo sapiens
  misc_feature (2692)..(2692): n is a, c, g, or t
ttgttaccagtatgcatatattttatacataatatatctttaaacataaacctaatacatacatatatacatgtgtagctgcacttgtgcaactcaacagtttttagtgcaaacagaatcttagtaatggaggtaaataaagaatgaataagaggtaaaaatggatatagaagtaaaacacaagacatgggggtataaataaattaaaactaagttctgaaaagtgacttttagtaatagaaacctaaaaacatttcatagaaggcaagaacaaagtctgacaacagagtttagttttagtggacattgtggtagtaaatatgtaagttacttctctcttcagaatacaacagatctcactgggccttccagggtcattattcctagaaataatcccactaaatgcccatcttagcaacgcacatttccatgtgtgagttatttctctctcagccccatttaaaaatgtgaaatttggatttagaaggggacatgtatttaaggaagagaagtgccacacaaataatggagcaattttaccatgaaattaatgtcatgaaaatagatatttctataaatacctcttgtttttattattaagacaatgcagacataaaacacttcatactgtagtttctacattgcagccaaaccacttatcaatggccaataaattacttcactcctatgatagatacaaatgctcgattcaagttcaattaatagaatagtgtcaggatatcatgcagacagcttgcataaatactcgaggaataatagcataccttcagtagattctgtgatttttaagcatgaaaactttgtcttattccaaatttcaaaagatggaataaagaatgttttcatataaaatacatttggaacagttttccttcttaaaaaaaaaggcatctaacccacttgcaacatatactggcaattcatctttgtagttacaaaatcagatagatatatattctttttcatctcatgtgactgtatgtgaacatttcagtaattccaacaatatcaaacagctaaattcaaaatcatataatactttctaataagtgtatacgatatatatcttttgtagccaaaggcagaaagaccttcagttagttgatttcatgtttgggcactagtttatattttatcagataattaaaagtcattagttatttcacagtataaaatattgaatcaattaccaacaggcttttattttctgctcctaatttcgaaatgtatttggactcgaggtatgggaataatgtcactgcttatcaaacaattttctggaaatcttaatgcacaaaaatttccagatttatatattcaaaaataaattatatgttaaatgaaattaagaaaaaaaggcgaggggaaggagaaaatctagtttatattctgtgtgaatagctttcaatatcttccaggtgggggcaaccgtaagccacttttgagagaagggagaacaggctctttaagctccctgagtctagttacagaagacttcctggcagtaacaccgtgaataaaacaaccacaagcttccaggagatgagacttctaggctctgctccagacaacacccggccatgggcaacagggcccaccgccctgggcgcgccgcagcctcggccactccgagtcggctccgatcgcgcacgcgcgccgtgcacctgccccatcgcgcccagctgctgcctgagctccgggcacgcccgcgctgtgccggcggggagtgtccgtcactctcagcgctcaggatctctccctttccaggaccgctaggaagcaggaaatccttttcctctcacgtttacatcccattcattcttcctccgggcaattcaagtccattcacagccgccacagatgcacgtgtgcacgcgcgcagctgcacctttaaagaaactctcaagtcctggcggccagaaaaccagctttcaggcggggcggtggggctccccctccccttgcttcgtctctgcagatctttgtgctctagggagggatggccgcacattctgacgaggacgagggtggtgcataacgcggaggtcaattttgcacagtccaggcaaaagagaccccccccccccaccaacatcccttcctgttcagtttccctctctggcccagcgcgaagggcgaggggcgacagaagcccgagggacagaaaaccgaggctcctcagtggccgagttgggagagagtgtgagtccaggagagcccgggggcagcagggagagggtgcagaagctcgagcgcaccgagccagaggccccctcttctcccgccacgcggggctggaggtgcaggcgccggttccgcggcgtggcccggctatgtgtcgctcctccgcgcgccgcccgccgcagcccgtgccctcgggccgccgccgccgccgctgccccccgtcgagcccgcggccgcaccctcgggccgatacttgagccagcagatgacccaggtgacaacgaccgagaagagtgccaggatgctggccaccgacaggcagatgggccccacgggcgagggcgagggcgacccggtggccggtgcctcgccagggggcgccccgcctccgggggttcccccgccgccgtagtggttgacgaagatgaggccggtgaagagcagcaccaccatggagaggaaggagaagaccacgcacacgcagccngcgtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgctaatagtgaatgtgatgtcttcagtttgaagggctttaagtgaagctcattaaaacccactattttccaaaaaaa

SEQ ID NO: 315244 - DNA, 3479 bp, Homo sapiens
  misc_feature (3091)..(3091): n is a, c, g, or t
  misc_feature (3117)..(3117): n is a, c, g, or t
  misc_feature (3163)..(3163): n is a, c, g, or t
  misc_feature (3187)..(3187): n is a, c, g, or t
ttgttaccagtatgcatatattttatacataatatatctttaaacataaacctaatacatacatatatacatgtgtagctgcacttgtgcaactcaacagtttttagtgcaaacagaatcttagtaatggaggtaaataaagaatgaataagaggtaaaaatggatatagaagtaaaacacaagacatgggggtataaataaattaaaactaagttctgaaaagtgacttttagtaatagaaacctaaaaacatttcatagaaggcaagaacaaagtctgacaacagagtttagttttagtggacattgtggtagtaaatatgtaagttacttctctcttcagaatacaacagatctcactgggccttccagggtcattattcctagaaataatcccactaaatgcccatcttagcaacgcacatttccatgtgtgagttatttctctctcagccccatttaaaaatgtgaaatttggatttagaaggggacatgtatttaaggaagagaagtgccacacaaataatggagcaattttaccatgaaattaatgtcatgaaaatagatatttctataaatacctcttgtttttattattaagacaatgcagacataaaacacttcatactgtagtttctacattgcagccaaaccacttatcaatggccaataaattacttcactcctatgatagatacaaatgctcgattcaagttcaattaatagaatagtgtcaggatatcatgcagacagcttgcataaatactcgaggaataatagcataccttcagtagattctgtgatttttaagcatgaaaactttgtcttattccaaatttcaaaagatggaataaagaatgttttcatataaaatacatttggaacagttttccttcttaaaaaaaaaggcatctaacccacttgcaacatatactggcaattcatctttgtagttacaaaatcagatagatatatattctttttcatctcatgtgactgtatgtgaacatttcagtaattccaacaatatcaaacagctaaattcaaaatcatataatactttctaataagtgtatacgatatatatcttttgtagccaaaggcagaaagaccttcagttagttgatttcatgtttgggcactagtttatattttatcagataattaaaagtcattagttatttcacagtataaaatattgaatcaattaccaacaggcttttattttctgctcctaatttcgaaatgtatttggactcgaggtatgggaataatgtcactgcttatcaaacaattttctggaaatcttaatgcacaaaaatttccagatttatatattcaaaaataaattatatgttaaatgaaattaagaaaaaaaggcgaggggaaggagaaaatctagtttatattctgtgtgaatagctttcaatatcttccaggtgggggcaaccgtaagccacttttgagagaagggagaacaggctctttaagctccctgagtctagttacagaagacttcctggcagtaacaccgtgaataaaacaaccacaagcttccaggagatgagacttctaggctctgctccagacaacacccggccatgggcaacagggcccaccgccctgggcgcgccgcagcctcggccactccgagtcggctccgatcgcgcacgcgcgccgtgcacctgccccatcgcgcccagctgctgcctgagctccgggcacgcccgcgctgtgccggcggggagtgtccgtcactctcagcgctcaggatctctccctttccaggaccgctaggaagcaggaaatccttttcctctcacgtttacatcccattcattcttcctccgggcaattcaagtccattcacagccgccacagatgcacgtgtgcacgcgcgcagctgcacctttaaagaaactctcaagtcctggcggccagaaaaccagctttcaggcggggcggtggggctccccctccccttgcttcgtctctgcagatctttgtgctctagggagggatggccgcacattctgacgaggacgagggtggtgcataacgcggaggtcaattttgcacagtccaggcaaaagagaccccccccccccaccaacatcccttcctgttcagtttccctctctggcccagcgcgaagggcgaggggcgacagaagcccgagggacagaaaaccgaggctcctcagtggccgagttgggagagagttgcaatacagttgacccttggacaacatggattggaaccgtgcaggtctactaactaatacacagattctcttccacctatgccacccttgagacagcaagaccaacccctcctcttcctcctccttttcagtccactcaatgtgaagacaaggaaaatgaagaactttatgatgatccatgctattagtctgttctcacaccgctaataaagacatacccgagactgggtaatttataaaagaaagaggtttaatggactcacagttctacatggctgcggaagccccacaatcatgatggaaagcaaaggaggagcaaagtcacgtctcacatggtagcaggcaagagagcatgtgtgggggaacttccctttataaaaccaacagatctcgtgagacctattcactatcacaagaacagcatgggaaaacccaccctcatgattcgattaccttccaccaattccctcccactatacgtggagattattacaattcaaggtgagatttgggtggggacacaaagccaaaccatgtcaatctatttccacttaatgaagagtaaatatatttctcttccttatgattttcttaataacattttcttctctctagcttactttattgtaaaagtatagtacatgatacatgtaacatacaaaatatatgtgaatcaactgttgatgttattggtaaggcttccagtcaacagcaggctattaatagttaagttttgggggagtcaaaaggtcaactgaatttcattgtatgattgtagcacattacatctatcatttttaactgtatatttttctttctaaataatttttaagctttttctttgagtattttttagtgagtcttcantagaatgtaggagtatcttcctattntctatattttactcctttaaatctgcttacttgttttaaatagtcncttgctataaatcttttaaattcntatgagattaaatatttccacttaagatgcaatggaacttactaaaaaagtgctaaaaagtaactatactgaggctgtgatcagtctctgagacccagttcctattgctaacagtactttggtttttggaggctgtcctcctacaactgagaaaagtaatctattaccaatatttaaagtattttccctattggtgctttgtttaaactttcttagagtttgtagtaacaaaagtgacatgttttaacaagtcaaacaacatagaaacacttaagaaaatctaataatctgc

SEQ ID NO: 315245 - DNA, 853 bp, Homo sapiens
ggcagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctagggtacaaacggaacggcggcgttttccttgtatcatttagaggaaatttttgagctgaacagtattttttttctccctctctctctctctgaaatattgctgagatttaaaggaggacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcttaaaccgagttcctgggctccctcactggcttcgtccacttaaacttttaacgtacacatgtagagagctgaaactccaggggtaacatgggacaggtcctcttgatttaatgaaaacagaagatcaactggaccgggtagcaagaaataaggcttaagaagcactggtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgctaatagtgaatgtgatgtcttcagtttgaagggctttaagtgaagctcattaaaacccactattttccaaaaaaa

SEQ ID NO: 315246 - DNA, 659 bp, Homo sapiens
ggcagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctagggtacaaacggaacggcggcgttttccttgtatcatttagaggaaatttttgagctgaacagtattttttttctccctctctctctctctgaaatattgctgagatttaaaggaggacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcttaaaccgagttcctgggctccctcactggcttcgtccacttaaacttttaacgtacacatgtagagagctgaaactccaggggtaacatgggacaggtcctcttgatttaatgaaaacagaagatcaactggaccgggtagcaagaaatcagtaaatcaccacacaagaggtggagaagaggacttataaatattgtttctatgacatttgaaaataaatgttttactccatgcta

SEQ ID NO: 315247 - DNA, 427 bp, Homo sapiens
cttctccacaacatccctgctcagcaactactggtttgtgggcacacagaaggtgcccaagcccctgtgcgagaaaggtctggcagccaagtgctttgacatgccagtgtccctggatggagataccaacacatccacccaggaggtggtacaatacaactgggagactggggatgaccggttctccttccggagcttccggagtggcatgtggctatcctgtgaggaaactgtggaagaaccagcactgctccatccccagtcctggaaacaatttagatgccttcggtccagtggtacagcggcagcaaaaggggagaggtgccgaagtttcattgaacagtaaatcaccacacaagaggtggagaagaggacttataaatattgtttctatgacatttgaaaataaatgttttactccatgcta

SEQ ID NO: 315248 - DNA, 965 bp, Homo sapiens
ggcagcctcaaccgcctggcagcggcggtttcttctcttcgtgaaaatcgtgatctcatctctccgtccatgggcgaaaaaacagccatcaccaggccattcacgctttgtgcttttgttagcagagcccaggcagccctgcagcccacatctagggtacaaacggaacggcggcgttttccttgtatcatttagaggaaatttttgagctgaacagtattttttttctccctctctctctctctgaaatattgctgagatttaaaggaggacgaagacaacagattcatagctgggtcttgctgttttcctgacgctgaccacagcggatctaggtggctatttcgttggtgcacaggcgttcacagaggcagagaggggagaaagttgtcaaacagattcacagactgtcaaagtgcggcttaaaccgagttcctgggctccctcactggcttcgtccacttaaacttttaacgtacacatgtagagagctgaaactccaggggtaacatgggacaggtcctcttgatttaatgaaaacagaagatcaactggaccgggtagcaagaaataaggcttaagaagcactgggttgggcctcaccctatgagcagggaacccaccttccccctcaacaaaagaaaagatgactttggaatgttctggattcccacagctgggaatgttcctacttttttttcagtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgctaatagtgaatgtgatgtcttcagtttgaagggctttaagtgaagctcattaaaacccactattttccaaaaaaa

SEQ ID NO: 315249 - DNA, 215 bp, Homo sapiens
tgggaaaaaggagtgggtggaagcatagagaaatcaggcctttagggatataccagcaactctgatcctgaagaggatgttggaagttcagggttataggaaatcctataattctagctataaaagatggccttttcattgatacatatctgctgaatcctcagcctagggcccagcctcatcataggtagtttcagggtttcccttctttctgt

SEQ ID NO: 315250 - DNA, 836 bp, Homo sapiens
  misc_feature (795)..(795): n is a, c, g, or t
  misc_feature (810)..(810): n is a, c, g, or t
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagatgactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggagangggccccatggaggnggcatcttatggcttcgcggctgtgc

SEQ ID NO: 315251 - DNA, 1672 bp, Homo sapiens
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgtaaaaaaaaaaaaaaaaaaaaaaaaaaaaaattttgggggggcttgggccctggaaaggtttgagaaaacacatctggtggggcacgcggggagccccaagagaggaaaaggaaacgcggtgcccacagcgggggtctcatagaggaacaccgaggccagagacaagaggcaggggaacctctacaccaattaaagaaagcccggggggaaccagaagggtttgagaacaacccaaagg

SEQ ID NO: 315252 - DNA, 1393 bp, Homo sapiens
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315253 - DNA, 1062 bp, Homo sapiens
gaacaaaagaagccagccacaaagaggaccgatacctatttccatctatttaaaacaaaaatcaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315254 - DNA, 1391 bp, Homo sapiens
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagatgactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315255 - DNA, 1383 bp, Homo sapiens
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315256 - DNA, 1018 bp, Homo sapiens
gaacaaaagaagccagccacaaagaggaccgatacctatttccatctatttaaaacaaaaatcaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagatgactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315257 - DNA, 298 bp, Homo sapiens
caacagagacaagcgcctgctccctgacttccttggccttcccaggatctgactcttccctttcctttcaccccagatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccaggga

SEQ ID NO: 315258 - DNA, 1435 bp, Homo sapiens
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315259 - DNA, 1121 bp, Homo sapiens
cgcaatcaccacatgtcaccaggactgcctttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315260 - DNA, 1450 bp, Homo sapiens
tacccactgggaatatgattatgcttaatctatgctcagtcgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagttgaatagtggaccttcctccccacaaaaagatatgtttaccaggaacctcagaaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315261 - DNA, 1068 bp, Homo sapiens
gtgtctatacccgatatgacacgcgtcgccagaatgttacctgtggatcagaaggcagtcctggtgacagtgtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315262 - DNA, 1077 bp, Homo sapiens
gaacaaaagaagccagccacaaagaggaccgatacctatttccatctatttaaaacaaaaatcaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagttgaatagtggaccttcctccccacaaaaagatatgtttaccaggaacctcagaaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 315263 - DNA, 6392 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccaggtaaatacagggatttggtaatggtgactgtgtgtgatgactctctttccattctattattcttccgtctctcccttagtggtattattacaagcaagtcaaataaatttcccaagtatttgaaatttgttttgttttatattgaggttatggaaaaggttccaaatatatttcagttccgattcaggctgactgctttgccatctgtagattcaaaaatccagagactagtgggcctctctgggactgtttgcgttcctaaaactgaggaaccagtttctgcaattaaaattctaaatgctcactgtgagtgcccccaactttcccacacatattcctgtctagtcacaagaggtctaatctgtgtatggcagtgtcattgtttcataattgtaagtttgctctgttttagccttttttaatttccttttagaatttattgttgtttatattctgtttgcttttgataaaatctttaacagttcacttttaatggctgagcttcagcttctttcttgatgaaaagtgaagatattcaacctgatcttaactatcctagcccaccagttgtcagaaatgctgcagtacaaactttcccacaaaggcatataacagtatgaatgcctctttagaagcgacaaaagatataatttttgcttctaaattggagcttagagcctgatgctttatgttaatctcattacatctttaatttcatatccaagtaaaacttcttacagattactcatggaacatattctataaatacttaatgtatatttgaaatgaatatagaagttaaggaagtagtaagtcagtgaaacaaactaacacaaaataatcgaactcaaatattttagccaataaaaagcaagaggaaagagaaagaaagaggtattaccgcagtacttgggatgcaaagacaaatgcatgatttattatgtctgtgtgtaatatgtagttctgcccaataatgcaaacaaaattgggctaataaaaattgtttgaactttttacagtctgaagttatactactcataactactgccatgtttgcttggagtgccacaggaaaaaatcgaggaaatattagttctgcttgctgagaaaaaaatgtaaaatcatgcatattgtaaaaacctactgaaggtcaaagcatgaactatccaggtttattattacttgttcttgacaaacagtttcttaaaataatggtttatttactaattctgaaagttttctcacactcctcttgatgtgactaaagcttcaaaagaaataaaaaacatgcacacaaaacaaacacaaaaaaaatccttatattttaagctacttagtgtgtgcctggcactcagtgtgtgaatatttctaggatactcacaccagtggtctaaatataataactaaaaatatttttctttcccttattttgtacttgtaaaatattatatacttatataatattatataatagttgcatcattttatataatcttatacttaagattggtgctttgctaataattctgagctccacaagtcctatttaatagtctctgtatgttgactttgcatttcctgatttaagcaaataatcatatttgtatgtatacaatttaaaaataaatgagtattcagcgaggcagataacatcctgtggacaggtactacgacaataagatagggagtggaaggaagctgagctagccaaatgtgtcagtgcgaaacatatgtcaccagtgtcttttctccttcctgtctttcattctctaatgtgtaatgctaaaagtatggagatagagacaacatgagttcaaaaatacgtgcatgtatgtatatataatctcttctgtgtttatattcatgtatttataaaaacattaatttatatctgtataaaaatgaatgtcaaaatgtgtacatataaataaccacaactttatatggatatatcaataatatagtttggtttcatataaactatggacacttattatttctataactatccatggctaaaatctaaagctttcaaaatacatcataccatgttcacttaggacttataaaaataaaatctgaggatttactagtctctagtaaacataaggaaaataacatttatttaataacaagcacagtgttaaatatttaatgtactttgtcaatttcctgacaataattatatgttatgaatattattatcctgattttagagatgaggaaaaaagctacgaaagtttattttacgactaatagagtaaggattcaaaatcagatctatttgatatcttctgtttaactagtttttccaaaaatatgaaaacttgtcctatgagatgtttcaccaataagagtttttgtgagtcaaatacattttggaaactttgcaactgaaagtgtctaccttgaaatttaatacacacagcatattaaagtcatgttctaaagaaatctgtatgtttagtttcttttctcccaaattgtttaatttcccaacctttttttagtaaaacgtgtctcgaggaagtggtagtatagagaaaatgctatagttgccttactgtatcctactgtgtcctaaatattgtgtacatgttaccacacacccctgttaagtggaagttatttcccacattttgtggatgtagaaacaggcttggagacttaatcgaattacccaggtcacagccaataagtggcaaagccaaggcaggaacttgaacattcagactataaattttgtgctattttctagctgtttcccattctatgttgatcccattcttgaaaaaaaaatcacttttgaagcaatgcttagaaaagttttatagcaacctattactaaagatatttgcctgaggttaggagttgaaaagaagagtcgactgtctagaaaggaggctaaatccttagtttcagtaaaatttgtcctcaacttgtacttaataaggaggaagctgaagcgggcagatcacttgaggtcaggagtttgagaccagtgtggccaacatggtgaaaccccgtctctactaaaacacacacacacacacacacacacacacacacacacaaattaggtgggcatggtggcaggtgcttgtaatcccagctacttgggaggctgagagaggagatttgcttgaacccaggaggcagaggttgcagtgagccaagatcacaccattgcactccagcctagataacaagagtgagactctgtctcaaaaaag

SEQ ID NO: 315264 - DNA, 6043 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315265 - DNA, 5926 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315266 - DNA, 5527 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315267 - DNA, 2249 bp, Homo sapiens
aaaccaggtcaaagcttctttggcattcagttttccccagagaacaatttaatgctgatacttaattttttcaagatagacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315268 - DNA, 261 bp, Homo sapiens
gttgttggaggaaaaatgactgacttaggacgacttggtgctttcatcaccaaagtaaagaagggtagcctagcagatgtagttggacacctaagagcaggtaaagtttctttttttaatatttaaacagtgtgttctccatgcatgaacatgaattggtggttttcaatttggggttagttttatatatacatacatacatacatgtatgtatgtatatatcaattaagtcactaaattttaatgcacgaataaagactt

SEQ ID NO: 315269 - DNA, 6121 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315270 - DNA, 5611 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315271 - DNA, 5374 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtaggcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaa

SEQ ID NO: 315272 - DNA, 4097 bp, Homo sapiens
  misc_feature (538)..(538): n is a, c, g, or t
  misc_feature (545)..(546): n is a, c, g, or t
  misc_feature (742)..(742): n is a, c, g, or t
  misc_feature (1159)..(1159): n is a, c, g, or t
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgngacaaannggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctnagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctngctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagaacaagaaaaatataactcttccacaaaagcaagcttagtagtggaggagcgaacaagacagatgaaaatgaaagtgcatcgatttaagcagaccacagggtctggttctagtcaagaactgatcgcgagcaatattccaa

SEQ ID NO: 315273 - DNA, 898 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtaagccattctgtattttgacaaatagaaacttaaagagcagaataatcggagaaaaacacacaactgaaacaacaaatgcaccaaagaagaaagtctattgcctggtttcttatcacgttaacatggaacaattattctgctaatttcagcgatccattgtcatgctgtcacattaaccatgaagaaacttgcattttgtgactctaacacctatgtgtgaaagcctgatgcctgagtcttaataaattaacggtgacagaaga

SEQ ID NO: 315274 - DNA, 662 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgcaaatgccagtgtcgtaccgagtaagtctgaggctctcaaattgtctttcagaaatgtaacagaaataatggcactacctgtaacagacacacagcctaacggagcgatcagagtaatggg

SEQ ID NO: 315275 - DNA, 399 bp, Homo sapiens
  misc_feature (5)..(5): n is a, c, g, or t
  misc_feature (13)..(13): n is a, c, g, or t
aaaanggcccccncccccctccccggttcataaaaaaaaaaaaaacttggggaggggaacaccggggggtttaattgcttcaaaatattttggctaaaaaaaattttaaaagaaaagtaaaaggtccatcctaagggccaagttaaaaagcaagtgtttttttgtgaaccccccccccccaaacacatgggaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaagcagaaaaaaaaat

SEQ ID NO: 315276 - DNA, 4595 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgttttctgtcattccttggtgtatttttggtcacaagaaatcgagaaaaggaacatctgcaacagtcttatattgattttggaaatattcctgacacaaccccagagagaaaggcttggagggaaacaaatgttggacaaaatacaaccagattcacatagcttatcctatggaactttgcctgatggaagtgactcaacaaagagccaaagtggagagaagaaagaggtctaaatgctgagaaggatggctgttggcctgttattcgataccacctttttaaaaaattgcacatgttcaatttgtgtcagcagctcttttataagctaacatgtgctagcattcatttcagtcctttcccccacctcagcgtctatggacaatcggggacttcctaagctctgacagtctaatatttccatggaatgtgatttggagtgttccccacaccctggacctctccctagtgattatctagccagctacaccttactcagagcccggctgctctagcaggaatgttgcacagaaacatacatttgcggtttggccacaggtcgcataggtggcttctcccacgggtagtgtcagttgcttcactttaaaaagtcacttcagccccacaacctcactcccaaaagaaaggtttgagagcgctcattttttttctaagacaccttttataagcctccctataaaaatctcacctttcaagtactaagttagaattgcaagtcatcttttctgaaaactaatgctatcaaagtcctcctttgaaaattaagggtctctttaaaattagaatttataaatggcattcagtgatagtgtacaccaaaattaaaagaccttgactggtgggctttttacgtgtaaggaagaggaagtttaagaagtaggactctgcttgtttcagtagcccatgtactaaaataggaacaatgcagagattagcacagcccctgcacaaggctgacacataaattcatgaagcgttagagacaaaaagtaggactaatgtttgtttattttttaataaaaatctagaatggtgatgttttcttcagctgtatgattctatcatacttgaaactgaagaaaaatttaatatcctatgtcttttttatagatcttataatttatcaagtggatttatatgtcttattctccatataagtctaaaaaatcacatttaaattcttagtgatagtttcactacacatcatttcttcccaaagtcattacctcaagctttgtaaattcttctagataaaaggagagttgtgattagagaactgaatttcagccatttaaacctgtagacatagaaaacaacccagtggtcaaacctgagcttcaagaggaagcccaagtcctcctgtttcctgaatggcttttccactccaattcatcacatatctgctaagacacatttgcaggtagaatccataataatatctgttatttatgatctacctaatatttaaaggagaagaaaagaagtagccttcgttgcagccaacatccaacaataagtcccacccttaatgacatttcaaagccttcagatcacttctgacatgtctgtccaatatcattccaatcaatagtcttgcatttaaataggttgtttaactcggtggtattgagactgtaaccttaatggctcaggtcttttagctttgttctttgtcataatctgcactcctggccagactgaccaaacctggctgcaaaggaaagagatttgaattgatcaccaatgtatgaaaaatacagaacccatgtctggctcctaaactcctggtaataattcccgccatcgtagcaagtgtcccatgcattcagataaagcagtcataatttatggtgtattttaccgaattggtccagcatattggtcctacaaggctcagccaagaaatgtatctggtgccttaaactacagatttctggtgactcttaaaactggtttacaaagattgagaaaacaattagattgaagagttttgcttcaagtagacctgcattcatagctagagtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagcagccatagacaagatgtaaacagaagagcatggctgtgttccagtaaaactttatttacaggccaggcatggtggctcatgcctgtaatcccagcactctgggaggctgaggctgacagatcatctgaggttaggagtttgggaccagcctggtcaacatagtgaaaccccatctctactaaaagtacaaaaattagccaggcatgacggtgggtgcctggagtcccagctacctgggaggctgaggcaggagaatcacttgaacccgggaggtggaggttgcagtgagccgagatcatgccattgcactccagcctgggcgatagagtaagactgtctcaaaaacaaacaaacaaacaaacaaacaaaaacaagtggccagtctgtgagctatagttcccaacacctggtctagactcttctgcccttgctctgcagcttctttcctgttgattgggcattcagggaaggagtttaaaaagtgacactcatggctcatgacaaatgagatactttgggagtgtggaaacatggcttgatatttgccttcagatatttttgcttatataagttctaaatggaagtgataagttcattcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaagcagaaaaaaaaat

SEQ ID NO: 315277 - DNA, 684 bp, Homo sapiens
tcgtgggggagaagaggctgggtctagcatgggctaggagggcctcatcagtggtgctctctaccttcctactccttacccacctctttgtatttttatttattcagccctcccaccacaggactttggagattgctggtgccacaaggcttggtcagaaaaagcaaattaggcaaacaaacaaacaaaaacaagtggccagtctgtgagctatagttcccaacacctggtctagactcttctgcccttgctctgcagcttctttcctgttgattgggcattcagggaaggagtttaaaaagtgacactcatggctcatgacaaatgagatactttgggagtgtggaaacatggcttgatatttgccttcagatatttttgcttatataagttctaaatggaagtgataagttcattcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaagcagaaaaaaaaat

SEQ ID NO: 315278 - DNA, 1454 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgagtaaatgtctcagaggtaaagcatgtgaaattctattacttttacgtaggattttcggcattgtaccggaggtatagaaaattggaaaataatataagaaacatcagtttcctgagctcctaaaagaaacatattttttaacttaaggccctaaacagggctcagcgtctttggctttgtgacttaggtatatctctgctgttctgaaacattggggatttccaattccaggccaaagacaagatacatc

SEQ ID NO: 315279 - DNA, 377 bp, Homo sapiens
ttatttttaactctattttttatttcacaaagctcagtgcataggctccgtagtagctttagaagtcactatcaaaggctatttttctatgttgttatatgcattcgacgtggaaaagaagacacaaccccagagagaaaggcttggaggtgagtgaatgcttcatgtgaatctccagactaaccccacctgatttccatggccagcatgtagatcctgtggggtggggatagtggctctgacacagacaattcgctatcacatagctacagacatggcgtttcaagggccttttcttccttgatattcatctcttctctttagagagtgcccacatagaataaaagagaggtaataaaatgtggcctagattgagg

SEQ ID NO: 315280 - DNA, 935 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgatttacattaaatggaagcctcacagagacaaggctcaggagcttttcctctgatctggtacagaaaagaaaggaaggaagatttgagaagcccagtgtataccagccagagaagaataaa

SEQ ID NO: 315281 - DNA, 700 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccaggtaagggccgccccgcagccaccgcagcccggtggggacgcggccagggcggctggctccgggcgcctctgcgcctcggccgctttcctgccagctctcaggaagacacccggcctctccgagtgggaagaggtgacatgcaatgtttcccgcattgacctaagtccgcctcatccggaagcgcgggggtccgcccagtcttcctctcccgggcacccggcactgggagtgggcgcccaggtcttcggccttgacctcagccacccgttcctgggacctccgggtcccgatcccgcctccccagcctgc

SEQ ID NO: 315282 - DNA, 4567 bp, Homo sapiens
agctggacggccccgggaggccgcagaccgccgggctccccgaggacacctcgcaccggaggaggagaggaggcagcgcccggccaggctgggagcacctacggccgcgcgggggcgggagccaggtggcctcggcgcgcccgcctcgcccgggcaccgagcaggaagtggctgcggcgcggcctcctcgcggtgcaacagggcggggaggcggccgcagcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgttttctgtcattccttggtgtatttttggtcacaagaaatcgagaaaaggaacatctgcaacagtcttatattgattttggaaatattcctgggaaacaaatgttggacaaaatacaaccagattcacatagcttatcctatggaactttgcctgatggaagtgactcaacaaagagccaaagtggagagaagaaagaggtctaaatgctgagaaggatggctgttggcctgttattcgataccacctttttaaaaaattgcacatgttcaatttgtgtcagcagctcttttataagctaacatgtgctagcattcatttcagtcctttcccccacctcagcgtctatggacaatcggggacttcctaagctctgacagtctaatatttccatggaatgtgatttggagtgttccccacaccctggacctctccctagtgattatctagccagctacaccttactcagagcccggctgctctagcaggaatgttgcacagaaacatacatttgcggtttggccacaggtcgcataggtggcttctcccacgggtagtgtcagttgcttcactttaaaaagtcacttcagccccacaacctcactcccaaaagaaaggtttgagagcgctcattttttttctaagacaccttttataagcctccctataaaaatctcacctttcaagtactaagttagaattgcaagtcatcttttctgaaaactaatgctatcaaagtcctcctttgaaaattaagggtctctttaaaattagaatttataaatggcattcagtgatagtgtacaccaaaattaaaagaccttgactggtgggctttttacgtgtaaggaagaggaagtttaagaagtaggactctgcttgtttcagtagcccatgtactaaaataggaacaatgcagagattagcacagcccctgcacaaggctgacacataaattcatgaagcgttagagacaaaaagtaggactaatgtttgtttattttttaataaaaatctagaatggtgatgttttcttcagctgtatgattctatcatacttgaaactgaagaaaaatttaatatcctatgtcttttttatagatcttataatttatcaagtggatttatatgtcttattctccatataagtctaaaaaatcacatttaaattcttagtgatagtttcactacacatcatttcttcccaaagtcattacctcaagctttgtaaattcttctagataaaaggagagttgtgattagagaactgaatttcagccatttaaacctgtagacatagaaaacaacccagtggtcaaacctgagcttcaagaggaagcccaagtcctcctgtttcctgaatggcttttccactccaattcatcacatatctgctaagacacatttgcaggtagaatccataataatatctgttatttatgatctacctaatatttaaaggagaagaaaagaagtagccttcgttgcagccaacatccaacaataagtcccacccttaatgacatttcaaagccttcagatcacttctgacatgtctgtccaatatcattccaatcaatagtcttgcatttaaataggttgtttaactcggtggtattgagactgtaaccttaatggctcaggtcttttagctttgttctttgtcataatctgcactcctggccagactgaccaaacctggctgcaaaggaaagagatttgaattgatcaccaatgtatgaaaaatacagaacccatgtctggctcctaaactcctggtaataattcccgccatcgtagcaagtgtcccatgcattcagataaagcagtcataatttatggtgtattttaccgaattggtccagcatattggtcctacaaggctcagccaagaaatgtatctggtgccttaaactacagatttctggtgactcttaaaactggtttacaaagattgagaaaacaattagattgaagagttttgcttcaagtagacctgcattcatagctagagtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagcagccatagacaagatgtaaacagaagagcatggctgtgttccagtaaaactttatttacaggccaggcatggtggctcatgcctgtaatcccagcactctgggaggctgaggctgacagatcatctgaggttaggagtttgggaccagcctggtcaacatagtgaaaccccatctctactaaaagtacaaaaattagccaggcatgacggtgggtgcctggagtcccagctacctgggaggctgaggcaggagaatcacttgaacccgggaggtggaggttgcagtgagccgagatcatgccattgcactccagcctgggcgatagagtaagactgtctcaaaaacaaacaaacaaacaaacaaacaaaaacaagtggccagtctgtgagctatagttcccaacacctggtctagactcttctgcccttgctctgcagcttctttcctgttgattgggcattcagggaaggagtttaaaaagtgacactcatggctcatgacaaatgagatactttgggagtgtggaaacatggcttgatatttgccttcagatatttttgcttatataagttctaaatggaagtgataagttcattcttagggtccaagttgaaaggcagtggttcttttgtgaacaccactaactacattcgaaaagcctctccaattccacattccaagtctataacagctttggaaatgagtaacaatgacctctcatgtagtagattaaagcagaggcctttgccatatgattgttttttggcttaaatgtttgcttgccctgtaactgtaatactttggttaccagaatcacttgaaaacaaatacaataaaaaaatttctcaagcagaaaaaaaaat

SEQ ID NO: 315283 - DNA, 176 bp, Homo sapiens
gaattgcaccactgcactccagcctggacaacagagcaaggttgtctcaaaaaaaagaaaagaaaagaaaaaatacccgaagctagcctgtgcctcccttcccctggaagaaggaacacaggaatctttgcttggcttcagagcttgaagaggaggcctttttggtgggaatggag

SEQ ID NO: 315284 - DNA, 539 bp, Homo sapiens
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctt

SEQ ID NO: 315285 - DNA, 570 bp, Homo sapiens
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttaaaaaaaaaaaaaaaaaaaacaaaaaaaaaa

SEQ ID NO: 315286 - DNA, 712 bp, Homo sapiens
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttaaaagcgaaaaaaaaggaaaagcccacaggccccccaaccaaaaaagctattttttgagttgcccctgtttgaatggaataaggattgaagggatatgagggggttttttttgggggggggctcggtccccaaaatccccattttggaggtcttattcccccctttattgggg

SEQ ID NO: 315287 - DNA, 447 bp, Homo sapiens
ctgtctcccgccacccacaccagctgtcccactcaccatggagaagatcctgatcctcctgcttgtcgccctctctgtggcctatgcagctcctggcccccgggggatcattatcaacctgacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttaaaaaaaaaaaaaaaaaaaacaaaaaaaaaa

SEQ ID NO: 315288 - DNA, 637 bp, Homo sapiens
ctgtctcccgccacccacaccagctgtcccactcaccatggagaagatcctgatcctcctgcttgtcgccctctctgtggcctatgcagctcctggcccccgggggatcattatcaacctggctggagtgtagtggcacaatctcggctcactgcaatctctgcttcccgggttcaaatgattctcctgcctcagcctcccaagaagctgggattacaggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctt

SEQ ID NO: 315289 - DNA, 690 bp, Homo sapiens
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttaaaaaaaaaaaaatttagaaataatgtaatgatatgcagaataggtgaggtatttgtgtttgttgatctttttgttatataatttgtggaatttcaataaaaaaaaaatttagggggggggcccatagaccaaatgcccccttttggtggg

SEQ ID NO: 315290 - DNA, 416 bp, Homo sapiens
ctgtctcccgccacccacaccagctgtcccactcaccatggagaagatcctgatcctcctgcttgtcgccctctctgtggcctatgcagctcctggcccccgggggatcattatcaacctgacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctt

SEQ ID NO: 315291 - DNA, 678 bp, Homo sapiens
cagctgtcccactcaccatggagaagatcctgatcctcctgcttgtcgccctctctgtggcctatgcagctcctggcccccgggggatcattatcaacctggtaagagggtcttcaggggaggcgcctcctgagtccccagatgaagacttcctaagcttggaccttgacctctgatgtctccacctggactggcaggggctgggaggagtggcatcttgcatccctctgtttacttccatgtcctgtcctatgcctcttcccagaggccacaggaaaggctgatcagcccctctccagctccaactggagcatgctcagagcagcagctcaacctggctatgagggaccttttttttcttttttttctttttgaaacggagtcttgctctgtcaccaggctggagtgtagtggcacaatctcggctcactgcaatctctgcttcccgggttcaaatgattctcctgcctcagcctcccaagaagctgggattacaggtgcctgccataacgctcagctattttttgtatttttagtagaaatagggtttcaccatgttgcccaggctagtctcaaactcctgacctcgtgatccgcccacctcggcctcccaaagtgctgggattacaggcatgagccacctcacctggccctacgagggagctttgtaaaaatcca

SEQ ID NO: 315292 - DNA, 331 bp, Homo sapiens
ggaacttctgagagcagctctcgctagccgcattctttcaccctccttagtcccccagttctagctgcgcacggatgccaggaggctcttgagggagtgggtgtcacacaggcagaaaggagggaaccagggagatgggaccatgacggacggctttttactgctttcttccagatgattcaactttccccagctcaggccctcaaccagtctatggccagttcatgacaagaagtaaaaactcacaaactgcccactcaagcccaaaccaattttgaacaagttcccaaaaggttttgcagggagatgaactagcctggaacccactaag

SEQ ID NO: 315293 - DNA, 893 bp, Homo sapiens
tggaagcccaaggtgggtggatcgcttgagcccaggagttcaagaccagcctgggcaacatgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagtgtctggcttaaaagaagacagctggcttctcacatctgctcctgtattcaacctgggatatattgttttatttgaagtataggaagaagtctggcctcacacagatgtgtagttggaaaaaagaggagtgttcttatagccttttcaggcaggaagtagagcctgggctgctgaaggcttcccgccacccgatagagcctgagaatggagcctggagaaagtagagcctggagatggggagagagaagctgagtcctgaggcctgatctgagcttctcgcggagctgcccttcagcccgcccc

SEQ ID NO: 315294 - DNA, 3422 bp, Homo sapiens
agaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttgctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacctgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttttaccctcttttcttcctggccaagccctctgaattcatctgttaatatcaaattgtatttttgccacatttctgtattggtgaaaagcgaatctgcagaataactgccaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 315295 - DNA, 1680 bp, Homo sapiens
gttctctagagtcctgctgtgatcttgggtgcctggagctggtcgtcgtattcaactgatcaatagacgggacgttttattctaatccatcagggaaatgagctgaatggccccagcaccatccaagttgacacagctaaaggaataaaaacatttcttaccacttgatttgttttccaagcaagtgctagaatttgctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacctgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttttaccctcttttcttcctggccaagccctctgaattcatctgttaatatcaaattgtatttttgccacatttctgtattggtgaaaagcgaatctgcagaataactgccaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 315296 - DNA, 1930 bp, Homo sapiens
agaggcgggagcccaggagagggtgcgggagctggcggggcggctcggagctgccaggacgccctggtcccagccgcgcacaggggagcgtggacggcagaggggctcggcgggagccgagatccgcccgtcccggctgcccctcggcctccctctgctcccacctaccccctgacacccatagaaaagcgtgcaaaggcgcggagcgggacggaaaccacaaataaatagcggcggcggcagcgcgtcatctggtggagcaggaagtgcaggcagagtccggaggctggtgctttctgcgcgtccccaggactttgccatgggctgggggccgcggaggctgcgagcggccgggcgagggcagcggcggcggcgtccgcaccggggctgagcgagcagcgacgcgaggggcgcgcggagatggcagcgtccagcaactccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaagtaagctcatgtctcgtgcacaaagcctgctctgctcctagagcggttaatgcatgaggaaaagtggacggcattcctccccagccataactgctggagtttcactgtgccaggaaccactccaggcactttcagtgtatcatccctatgaaaggggcgccactgtgatggctcacgcctgtaatcccagcactttgggaggccgaggtgggcggatcatgaggtcaggagattgagaccatcctggctaacacggtgaaaccctgtctctacta

SEQ ID NO: 315297 - DNA, 2993 bp, Homo sapiens
gtgtgtttgagtgtgaaatgtgctaataaggaggagagacctctcctttgcaatgtgctgcggcaggagaaagcaggctgccggcccctgcctccctgaatcctcagtggctgactggataccgcttctgggggttgctgtgcacatgaatgtttgctattgttccaggcgcacgtcggccttaagaaatagcacaaaacaggcccatccttattcagaagccgggccccctccatcactcaaactgggcctttcaggtcacatgccggaggctgctgcagacaggacccagctgcctcaaatctgccgcctaacataagctgcggttcgaaaatcctgacagcacagggcttcctgggctctgcagagcaaactggaaagagctgggatccaggcactatgttctctgaagaactgtggctggaaaatgagaaaaagtgtgctgtggttcggaagtctaagcagggcaggaaacgccaagaactgctggccgtagccttcggggtgaaggtgggtgtcaaaggcggctttctttggccccctctcaaactctttgcctgttcacagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttgctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacctgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttttaccctcttttcttcctggccaagccctctgaattcatctgttaatatcaaattgtatttttgccacatttctgtattggtgaaaagcgaatctgcagaataactgccaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 315298 - DNA, 3440 bp, Homo sapiens
gaattccgcctcacagtggccaggtcctgtgccagattgtccctctcaacctccagccgggcgctgttggcgtgagttgatcgagccgcagccgcagctctcgcagctcagcctggtagacgtctgccagcttggtgggctccttggcccgcagctggttcagcctcagcagccagcgccttgttttgctgttccaggaagcgaaccttctcgatgtagctggcaaagcggtattgagctccatcatctctgcccgctcactggcccgggtctccttgaagccagcattgagtgccccagccagggagaaatccacccgggtcggagtggagggggcattcgagccagggagaggcgggtgcaggacccagacggcggccaggagccaggccccccaccatcatctcccctgaggagacgtaggagcggcgagcagcggaggtgatgcgtctcctctccagcctgtccggctcgtcggtgtcctccgatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttgctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacctgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttttaccctcttttcttcctggccaagccctctgaattcatctgttaatatcaaattgtatttttgccacatttctgtattggtgaaaagcgaatctgcagaataactgccaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 315299 - DNA, 3220 bp, Homo sapiens
agcgggtatagatgagattgagcatttggctgtgtgtggacacgcttcatcgtgccaactcaactagccctgggatgccggaggaagaaaatcacaaaaggaaacttaggatgcccaggttccagcacaaaatgcacttcccactgccgaggtgaaactatctgaggcattgaatgaggaacaatacaatttttgagaaagctaaggaggtgcctaccaacccgcaccaacgcatttgtttttgagaaacgtggtgcttatttgcaaatgctgaagaataccagcctcctatatggaaatcatacttatatcagttacagcaagaggcacctcgtcccaagagaatcatttgtcctcgggaggtggaaaacagaccaaaatattatggaagagagtttcatgggatcatctctcgggagcaggcggatgagcttcttggaggcgtggagggtgcctacatccttagagaaagccagcggcaaccaggatgctacacgctggctctcaggtttggaaaccagaccttaaactacaggctcttccacgacgggaaacactttgtgggtgagaagaggtttgagtcgattcatgatctggtgacagatggcttgataacactgtacatagaaacaaaagctgccgagtacatttcaaaaatgacaactaaccccatctatgaacacattggatatgccaccctactcagagaaaaagtatccagaaggctgagcaggtctaaaaatgaaccaagaaaaacaaacgtcacacatgaagaacacacagcggtggaaaagatctcctccctggttcgaagggctgccctcacacacaacgacaaccacttcaattatgagaagacacacaactttaaggtccacacgttccgaggcccacactggtgtgaatattgtgccaatttcatgtgggggctcatcgcccaaggggtccggtgctcagactgtggattgaacgtacacaaacagtgttccaagcacgttcccaatgactgccaacctgatctcaagaggatcaagaaagtgtactgttgtgacctcacaacacttgtgaaggctcacaacactcagagacccatggtggtagacatatgcattcgggaaattgaagcaagaggattaaaatcggaaggcctttacagagtctctgggttcactgaacacattgaagatgtcaaaatggcatttgacagagatggtgaaaaggccgatatatctgccaatgtctatccagacataaacatcatcactggagcccttaaactgtatttcagagacttacccatccctgtcatcacatatgatacctattccaaatttatagatgcagcaaaaatctccaatgcagatgagaggctggaagccgtccatgaagtgctgatgctgctgcctcctgcccactatgaaaccctccggtacctaatgatccacctcaaaaaggttactatgaatgaaaaagacaatttcatgaatgcagaaaatctggggatcgtgtttgggcccactctgatgaggccccctgaggacagcaccctgaccaccctgcatgatatgcggtaccaaaagctgattgtgcagattttaatagaaaacgaagacgttttattctaatccatcagggaaatgagctgaatggccccagcaccatccaagttgacacagctaaaggaataaaaacatttcttaccacttgatttgttttccaagcaagtgctagaatttgctggactgcagaggatcgctgagtggggtactgtgtctcatagacatgcgccacctccacgtgagaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacctgtatcgtaaaatgtatttttattttacccacgagaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttggatagtttttgctcttaagcattggcattcttctattgtatggtatgtatttatagcaattgtaggatggtctgaaatgtccacacactttctatgcatacaaattttgtgaattcccaaagtatgctttggaattggtcatagtcttttcgtatcatgagtgtgtatcccagaagatacagaatgcggtcattttacctgaaattatttgagaacactggatgtatctggtctgtgtaaaaagttagcacttttaccctcttttcttcctggccaagccctctgaattcatctgttaatatcaaattgtatttttgccacatttctgtattggtgaaaagcgaatctgcagaataactgccaacgtttttcattcttgttttacaaacctattttttaaagtgagaataaggttggtttttaccaaatatttgttcctccttgacaaaagtagctctgtgtggataatatgattttattactacagttccagtcacttggttatatttatcttagcatgagcctttcacaccaagatttctatattttgtaacataggtgaaatatttaaaacatcaaaaactgtaaatctagatttttaaaaaatccaactgcaatgtcttttcctttgattgagatgatttgtgtaaactcaccagtcttgctttggagtgagcagaagagaatgactattttacgtggagcatcattgtgtgactgttgacctggacagtcccaagggctatgcagatggactccattggcacagggaggtttgacctcttccctgctattatccctcctcccaactgtacagatttgtttgttgtagtttatgtacttcttgatactgtcaaaaaattatctggaaatggttttattttgtgaagtgaacaatactttgtaatttatgatagtgtaaatggaaggcaaagcatcacatgtattaaattcttctgtctatta

SEQ ID NO: 315300 - DNA, 2275 bp, Homo sapiens
aacaaacttagaaaacttcatgtactctggagttcacaggtgttttccttttgcatgttgccttctcctttcctcctatcacaaagaatgcttctattatcactcccagtcacttaaatgccattctgcttctttagcaggaaaaaatacctgaatgaattctcttacagaaagacagtttgactgaatttgctttttacaatcagtgtggaaaatatcatagtcaattgaggcaatcagtagaaatctcactaaaagtttgtaccccctgagtatgggtaacagcttaaacggcaagaatatataaaagtagcaacagtttagtgggagccaaaaagcactaggttaaatatcatactacgtttttaaagacttgataaatgtgtacacttgaacaaccatccagagggatagttacttgagcattacagagtagtggaactcaaaatctaagattcatctgggatacttctaaaagaaatgtagagttttgaatctcactcttaaaaatgtgtattcccaggctaggcatggtggctcacgcctgtaatcctagcactttgggaggccaaggcgggtgaatcacttgaagtcaggagatcaagaccagcttggtcgacatggtgaaaccccgtctctactaaaagtacaaaaaaattagctgggcatgatggcgtgtgcctataatcccacctactcgggaggctgaggcaggagaatcgcttgaacctgggaggcggaagttgcagtgagccgagatggcgccactgtagtccagtctgggcgacagagtgagattctgcctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttaaaagaatgcgatattgataccgatgcttactttttttttttttactacttgttttattcctt[450 bp omitted]cttccttggtatagtggaggatttgaggattggaatatagagtagagtgcttgcttaagcctgggagcccatctttatagctatttgatgtaagaaaagagacatggccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaa

SEQ ID NO: 315301 - DNA, 2381 bp, Homo sapiens
  misc_feature (2372)..(2372): n is a, c, g, or t
aacaaacttagaaaacttcatgtactctggagttcacaggtgttttccttttgcatgttgccttctcctttcctcctatcacaaagaatgcttctattatcactcccagtcacttaaatgccattctgcttctttagcaggaaaaaatacctgaatgaattctcttacagaaagacagtttgactgaatttgctttttacaatcagtgtggaaaatatcatagtcaattgaggcaatcagtagaaatctcactaaaagtttgtaccccctgagtatgggtaacagcttaaacggcaagaatatataaaagtagcaacagtttagtgggagccaaaaagcactaggttaaatatcatactacgtttttaaagacttgataaatgtgtacacttgaacaaccatccagagggatagttacttgagcattacagagtagtggaactcaaaatctaagattcatctgggatacttctaaaagaaatgtagagttttgaatctcactcttaaaaatgtgtattcccaggctaggcatggtggctcacgcctgtaatcctagcactttgggaggccaaggcgggtgaatcacttgaagtcaggagatcaagaccagcttggtcgacatggtgaaaccccgtctctactaaaagtacaaaaaaattagctgggcatgatggcgtgtgcctataatcccacctactcgggaggctgaggcaggagaatcgcttgaacctgggaggcggaagttgcagtgagccgagatggcgccactgtagtccagtctgggcgacagagtgagattctgcctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttaaaagaatgcgatattgataccgatgcttactttttttttttttactacttgttttattcctt[450 bp omitted]cttccttggtatagtggaggatttgaggattggaatatagagtagagtgcttgcttaagcctgggagcccatctttatagctatttgatgtaagaaaagagacatggccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaaaaaaaaaaataaaaaaaaactccaggggggggcccggtcctcaacttcgcctttagtgggtcggattccaattaacttggccgtcctttataaccgnctgactgtg

SEQ ID NO: 315302 - DNA, 2218 bp, Homo sapiens
aacaaacttagaaaacttcatgtactctggagttcacaggtgttttccttttgcatgttgccttctcctttcctcctatcacaaagaatgcttctattatcactcccagtcacttaaatgccattctgcttctttagcaggaaaaaatacctgaatgaattctcttacagaaagacagtttgactgaatttgctttttacaatcagtgtggaaaatatcatagtcaattgaggcaatcagtagaaatctcactaaaagtttgtaccccctgagtatgggtaacagcttaaacggcaagaatatataaaagtagcaacagtttagtgggagccaaaaagcactaggttaaatatcatactacgtttttaaagacttgataaatgtgtacacttgaacaaccatccagagggatagttacttgagcattacagagtagtggaactcaaaatctaagattcatctgggatacttctaaaagaaatgtagagttttgaatctcactcttaaaaatgtgtattcccaggctaggcatggtggctcacgcctgtaatcctagcactttgggaggccaaggcgggtgaatcacttgaagtcaggagatcaagaccagcttggtcgacatggtgaaaccccgtctctactaaaagtacaaaaaaattagctgggcatgatggcgtgtgcctataatcccacctactcgggaggctgaggcaggagaatcgcttgaacctgggaggcggaagttgcagtgagccgagatggcgccactgtagtccagtctgggcgacagagtgagattctgcctcaaaataaataaataaataaaaatttgtattccattgatttgggtagacaccaggaatgtgcatttctaacaagctttccaggcgatcctatagtaagtcatctgtggactactttaagaaactcttctatagagaatggagttggattaataataggtgattttttacactggactgattcacaagaacctaaacagtagtccatgaagctgctcatctgtggtaactatttggccccgtctcactctgaaagcagcaggagatgttgtttactttgtttctatcccctttgtctggagattaattttggaatgaaagtttttctctctatgccattcctggttcttttccaaagcctcatacaagaggattaggtcacaatgcatgcattaccttttttcctt[450 bp omitted]cttccttggtatagtggaggatttgaggattggaatatagagtagagtgcttgcttaagcctgggagcccatctttatagctatttgatgtaagaaaagagacatggccatttctaaactatataaggtgagtgtgtctattcccagcagatataaaggaaaaaggaaacttttttgattcccaccttcccagcctcacctagccatcttccagcctcaaatatagagatgttagtgcaaggtcctgggctctaggtgatcatttcataagtcctttacagataaagaaaaagtagtgtttgtatgtttgtttttaagtaaccccaaaacaaatttatattgtattcagcaaaattggaattcaggtgtttaattttagaacatgaagtgcctgctgttttaagcattgacttgtataaaaagaattgcatgtctccagtaagcttatgggttttctcatttttaggtatatggcttttaatcatgtaaagtgaaacattagttttcttgcattttattacaggttctttgttgcaataaagatgctgctgaaattaa

SEQ ID NO: 315303 - DNA, 720 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacgcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315304 - DNA, 903 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccaggtggaggaacgcgaactgggggttgtgggggtggctttgtggagtcagccaccctctttagttcttgcttgggcttcgctcccagctctaaggacacctgccatctagagcgctttctctgttaaagtagattttcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315305 - DNA, 859 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccaggtggaggaacgcgaactgggggttgtgggggtggctttgtggagtcagccaccctctttagttcttgcttgggcttcgctcccagctctaaggacacctgccatctagagcgctttctctgttaaagtagattttcagccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315306 - DNA, 488 bp, Homo sapiens
actagtaccagtttgtgatctgatggttggaaacccctgctctagagtataaagccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315307 - DNA, 1218 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccaggtggaggaacgcgaactgggggttgtgggggtggctttgtggagtcagccaccctctttagttcttgcttgggcttcgctcccagctctaaggacacctgccatctagagcgctttctctgttaaagtagattttcagccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattcaagttcctactgttctctgttgaaaataccattctcattccagaggaggcagagttttacctctatccttcaagagtttttcagctgggcctgagaattaaatggacataagacagatcaacaggaggaaagcatacagacttatttaatacaagtttcacttggcatgggagccttcataaagaaataaacactcggcggggcgtggtggctcacgcctgtaatcccagcactttgggaggctgaggcgggcgtatcatgagctcaagagatcaagaccatcctggccagcatggtgaaacctcgtctctcctaaaaatacaaaaattaactgggtgtggtggcacatgcctgtagtcc

SEQ ID NO: 315308 - DNA, 702 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattcaaaaaaaagaaaaacggtccccccccatcattttccccgtactccgttttcggaaaaaaaagaacacaaatggccccgttggcccaac

SEQ ID NO: 315309 - DNA, 864 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcagcctctctgatccctcaatttggtctgttttcaaaatatagaacgggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattcaagttcctactgttctctgttgaaaataccattctcattccagaggaggcagagttttacctctatccttcaagagtttttcagctgggcctgagaattaaatggacataagacagatcaacaggaggaaagcatacagacttatttaatacaagtttcacttggcatgggagccttcataaagaaataaacactcggcggggcgtggtggctcacgcctgtaatcccagcactttgggaggctgaggcgggcgtatcatgagctcaagagatcaagaccatcctggccagcatggtgaaacctcgtctctcctaaaaatacaaaaattaactgggtgtggtggcacatgcctgtagtcc

SEQ ID NO: 315310 - DNA, 615 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315311 - DNA, 765 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315312 - DNA, 676 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315313 - DNA, 1244 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccaggtggaggaacgcgaactgggggttgtgggggtggctttgtggagtcagccaccctctttagttcttgcttgggcttcgctcccagctctaaggacacctgccatctagagcgctttctctgttaaagtagattttcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattcaaaaaaaaaaaaaaaaaaaaacaacaaaaaaaaaaaagaacaaaaaacaaaacaaaacaaaaacaacgaaaaaaaaaaaaaaaaggggggggcgcgcggcaccaaacaaaatcccccggcgaagagggggcacatgcatgaggcagacccccaacgttggtttgtgggggaagcaggggcggcccacaaaaagaggaggtgttaaatataaacacacaaccagggcgggcggcggtcttataaaccaaccgacacgcaagaaaaacaatgcgatacgggggagacttgtggcgcagagcacaaccctcgggggggggacaagtggggggcacacacacccaa

SEQ ID NO: 315314 - DNA, 611 bp, Homo sapiens
agcgggccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 315315 - DNA, 1929 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315316 - DNA, 414 bp, Homo sapiens
aaatgcaagcccgtgttgtcatagaaaaacagaaaccagatggttgctatggagatttgtttaaatacacacctagaacatggcccagttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315317 - DNA, 2264 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaaccaaaaaaaaaaaaaaaaaaaaaaaaaaaaattgggggggcgcggggccaggaaaaaagttttcaacaccccatctctctgggggcggcggcgcgcgcccatggtaggacatctggacaacttgggcgccacagcggtgtgccaaagggagaccctccggcgcacagcgaaataagggcgtgggttctccccccaaaataaaaaaccgccgcggcgggccaccggggtgctctcggacccacaccccagaggggattgccgggagggccgcagccggggtctcacacacaccaggggtccccaggagacgcaggaaaaatacgcggcgcggtggga

SEQ ID NO: 315318 - DNA, 1749 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggtcaggggcccccagcacgtgcaaggggctggcagtgtctagggtgctgggtagagcatgagggggaacacagaggtctggggttgatggaaacctgttgct

SEQ ID NO: 315319 - DNA, 1707 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccaggttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315320 - DNA, 1801 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315321 - DNA, 2183 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggtaaggcagcccttgtgagacagaagagccacccagctgtggcgctcacctctgtcctaccgctccagcctcccgccctggctgcttcctcctgccccttccccaagccgaggcggggggaacagccgcctgcgctctcttgggaccctagatttgggggaggaggtaacgagaggcggagagggtggctcctcaaatatacacccctcctgtcctccgccaccccacctttgatttctcttccctcaacccagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315322 - DNA, 1436 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtgataaaggccccccctgcataaaggtgcctccagctctcagacattcctagaccggatggtaaagactattgcgaaagcctatcgatatg

SEQ ID NO: 315323 - DNA, 1417 bp, Homo sapiens
tgatcgatcccccatgtgtgtaatgtgcaccccagcatggaggaagcgtggctgcaagtaccaacatgtcagccacttgaggacgggaccttgtcaaatgcaaaaagcctgtgcttccccacagccagggtcatttccacaaatgtgggtcttggagtggggtccttgcttacgacttctggcctgcgtttctcctcaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315324 - DNA, 973 bp, Homo sapiens
aggctcccgagcagttgggattacaggtgcccaccaccacacccagctaatttttgtatttttagtagagacagggtttcgccatgttggccaggctgttttgaaactcctggcctcaagcagtccgcccactctggcctcccaaagtgctggcattacaggcgtgagccactgcacccagcctgattcctgtttttctcatagtgtttaaataccgtgtatagtgctgggacctgaactcagatctgctcaagtctgcctttcaccgaatcacatgcaggaggctgcatgcaggaggctgcagaaattagatggctgggttgctggggttcctgttgagctgccatggctcccgcccgctcccagatcttcctgccttccttcccaacaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315325 - DNA, 1050 bp, Homo sapiens
aagactgatgctgtttctccctgtcctcaggcgccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtgggtgagtggctggggctgggaggagggagtcagtggctggatgcagggggcttccatccaaggtggtaactagagcgtccaagaccaaaggaggaacggtgctaaaagccaggcgactgaaagtgatgtacaaacagggcggaattctgcaagtatcaagcaagtagcttaacactggtggctgaagggaaggacgcagctcttacaagtgtggagcatcttacagttaaagagaatgtgttagattcccatgacacccctgtgaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315326 - DNA, 640 bp, Homo sapiens
cgggcatggaccacagagattgcatcttgtgagtctgtagaaatggtcaaagccttgtcctctcttaggtccagagctcaggtgaatgcagattttcccggccatctgtgctgaagtccctgtgggaggctcctggctggtttcctgtaggtagacagctacacgtcctgcccttcattggcttcttttcatgaagctcctgccatctacaaaacatgtctcccttcttgaatcacatctctgttattgaaactcttgaactcctgaccttgtgatcctcctgcctcggcttctcaaagtgctgggattacaggcgtgagccatcgcgcccggccaattgttgcttctttttcaacaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315327 - DNA, 2001 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaacacttccaagtctgttgtctcatctgattctcccagtagcccattaaaggcccagtcattgttactgcctgca

SEQ ID NO: 315328 - DNA, 1913 bp, Homo sapiens
  misc_feature (1653)..(1653): n is a, c, g, or t
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgnggctgctacgttgccaccctggagtaactgtgtcatgtgctcccatgccatcctggagcaggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagact

SEQ ID NO: 315329 - DNA, 1702 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgagcccccgcggcaccccggggccaccaccggcccacggagcagcactccagccccac

SEQ ID NO: 315330 - DNA, 1879 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315331 - DNA, 2015 bp, Homo sapiens
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtgtgttctacatgccgggcccagcttcgcggccagcatttctacgccgtggagaggagggcatattgcgagggctgctacgtgggtgagtggctggggctgggaggagggagtcagtggctggatgcagggggcttccatccaaggtggtaactagagcgtccaagaccaaaggaggaacggtgctaaaagccaggcgactgaaagtgatgtacaaacagggcggaattctgcaagtatcaagcaagtagcttaacactggtggctgaagggaaggacgcagctcttacaagtgtggagcatcttacagttaaagagaatgtgttagattcccatgacacccctgtgaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggtcaggggcccccagcacgtgcaaggggctggcagtgtctagggtgctgggtagagcatgagggggaacacagaggtctggggttgatggaaacctgttgct

SEQ ID NO: 315332 - DNA, 1286 bp, Homo sapiens
  misc_feature (1272)..(1272): n is a, c, g, or t
catccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttgccaatgtggtgggttgcgaaaaaaatgtggtgggggattgggcctgggatatttacttatgcctctaatttttattctaactttacttaggggtnttatggggttttta

SEQ ID NO: 315333 - DNA, 746 bp, Homo sapiens
gtgatccacccacctcggcttcccaaaatgctgggactacaggcatgagccaccgcgcccagcctgcattttctttagttcaatgcattaagtgcgttcacattgttgtacaaccatcaccactatccatctccagaactctttttcatcttcccaagctgaaagccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaac

SEQ ID NO: 315334 - DNA, 399 bp, Homo sapiens
acccctcctgtcctccgccaccccacctttgatttctcttccctcaacccagcactccagccccaccccagggtcaatttttgcccccttccatctgagcagtgttaccaggccccagggggaccggaggatcgggggccggcgtgggtggggtcccatggagtactccagcacacgcaggtgagacccgggatcgtggggtgggacatgtgggatcccccagaaccgagtctgagggacccaggacaggagaaggcctatggtgatttgcattcttcctgccctggctccatcctcaggggctccctgcagacagggggggccttcgccctggaagcctggacgccgagatagacttgctgagcagcacgctggccgagctgaatgggggtcggggtc

SEQ ID NO: 315335 - DNA, 652 bp, Homo sapiens
ggaagtaactttagaggaggatctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcgcctggaaaaagtctgggatatttggccttctcaatatgataatctggggaagaaatgctttgt

SEQ ID NO: 315336 - DNA, 2133 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315337 - DNA, 2256 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgagaagacaatcccctcatcatatacctcacttaggaacctttataatgcataaatacatcatcattaatttgtgaacacagcatgaatattaagaaacccgaactccaaaatgcacaaaacataacgtcgaagcggccacgtactacaactac

SEQ ID NO: 315338 - DNA, 2024 bp, Homo sapiens
ggaagtaactttagaggaggatctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaatcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315339 - DNA, 2078 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315340 - DNA, 2078 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315341 - DNA, 1533 bp, Homo sapiens
tatcctatatagtgaagcagaattcaccaagcgtagcattgttcacttaggcacatacacacacactggcacacgcaggcatcatccatccgtcattcattcaaatatttattgagcacctactatgtgcccagccctgttctaggcactgggcattaccatggagaacaaaatagacaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315342 - DNA, 808 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgggatatttggctttctaaatttggtactttggggagggaattccttggttggggtcccagggtaaccagcccaaccaggtcgtgtaaattcctatgcccccttttgagcc

SEQ ID NO: 315343 - DNA, 524 bp, Homo sapiens
attttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggaga

SEQ ID NO: 315344 - DNA, 2180 bp, Homo sapiens
agcgcggcgcgggcccaacgagcgcacgcgtacacgcgtgcgcaggggaagaccgagtgccagggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315345 - DNA, 2291 bp, Homo sapiens
  misc_feature (2189)..(2189): n is a, c, g, or t
  misc_feature (2224)..(2224): n is a, c, g, or t
  misc_feature (2230)..(2231): n is a, c, g, or t
  misc_feature (2235)..(2235): n is a, c, g, or t
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaaaaaaaaaaaaaaaaaaaaaaaaaaaaaaaaaaaaagcgttgcggccgcaagcgtnttccctttagagagggagggggggcgcgttcgatntggttnntagntggctgaggtgagtgggggggggggggggggggggggggggggggggggggcggga

SEQ ID NO: 315346 - DNA, 2097 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacttgttttttttctatcttttttgtctttccttatcttgcacaatcgttatcaatcatgtccagatgtttcgattgcataccaatctatagagcttcaaccatggcaagatgtacttcccttagcaacactgcacacgctatatattcaggaccgagccct

SEQ ID NO: 315347 - DNA, 2255 bp, Homo sapiens
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatggagtttcgctatgtcgctcagactggagtgcagtggcatgatctcggcacactgcaacctccgcctcctgggttcaagtgattctcctacctcagcctcccaggtagctgggattacagatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315348 - DNA, 2023 bp, Homo sapiens
ggaagtaactttagaggaggatctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 315349 - DNA, 722 bp, Homo sapiens
  misc_feature (688)..(688): n is a, c, g, or t
agcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagccaaatatcacagatacatttagagatcccatactggtcacagagncacaagctaacacagtactgctttctcctcgtcc

SEQ ID NO: 315350 - DNA, 722 bp, Homo sapiens
  misc_feature (24)..(24): n is a, c, g, or t
ccgaaaggaaatggcatggtagcnctagtggatcccccgggctgcaggcttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacatacccgatcttgtacctgcacgccacgtgaatggaggacaagcccttagtggaacggcccatttggagaccggtcccc

SEQ ID NO: 315351 - DNA, 210 bp, Homo sapiens
ggggggggcaaaaaaccccaaatttgttttggggttcaacaccccaaacattattgtcgaatttaaatgatattaattttctcaagctatttttgttactattttcctaaaattgaatatttgcagggagcacttatactttttcctaatgtctgtataacaaatttctatgcaagtacatgaataaattatgctcacagctcaaaaaaa

SEQ ID NO: 315352 - DNA, 3935 bp, Homo sapiens
  misc_feature (2781)..(2781): n is a, c, g, or t
  misc_feature (3195)..(3195): n is a, c, g, or t
cctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgtggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaanacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaanaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacctgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctcaaaaaaa

SEQ ID NO: 315353 - DNA, 3573 bp, Homo sapiens
  misc_feature (2419)..(2419): n is a, c, g, or t
  misc_feature (2833)..(2833): n is a, c, g, or t
cctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattatagtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgtggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaanacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaanaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacctgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctcaaaaaaa

SEQ ID NO: 315354 - DNA, 3327 bp, Homo sapiens
  misc_feature (24)..(24): n is a, c, g, or t
  misc_feature (2173)..(2173): n is a, c, g, or t
  misc_feature (2587)..(2587): n is a, c, g, or t
ccgaaaggaaatggcatggtagcnctagtggatcccccgggctgcaggcttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgtggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaanacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaanaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacctgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctcaaaaaaa

SEQ ID NO: 315355 - DNA, 1492 bp, Homo sapiens
cctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtggtgagtctcccacgcccctgggggagggctgctcatgactacaggatctcaatcaaggataagcagtaaaaacggactgcatgaaaaatcagggccagggttctggcttgagcccacttgctgtctaagtgtgtgaacaggacaagtgacgtcccctctctgagagcattaaaatcacctctgcctacctctctgatg

SEQ ID NO: 315356 - DNA, 4093 bp, Homo sapiens
  misc_feature (2939)..(2939): n is a, c, g, or t
  misc_feature (3353)..(3353): n is a, c, g, or t
cctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgaggttggattgccagcttgtacctggcccttctgtttggccacgctattgttcctcatcatgaccacaaaaaattccaacatctacaagatgcccctcagtaaagttacttatcctgaagaaaaccgcatcttctacctgcaagccaagaaaagaatggtggaaagccctttgtgagaacaagccccatttgcagccatggtcacgagtcatttctgcctgactgctccagctaacttccagggtctcagcaaactgctgtttttcacgagtatcaactttcatactgacgcgtctgtaatctgttcttatgctcattttgtattttcctttcaactccaggaatatccttgagcatatgagagtcacatccaggtgatgtgctctggtatggaatttgaaaccccaatggggccttggcactaagactggaatgtatataaagtcaaagtgctccaacagaaggaggaagtgaaaacaaactattagtatttattgatattcttggtgtttagctggctcgatgatgttaacagtattaaaaattaaaccccataaaccaactaagccttatggaattcacagtcacaaaatcgaagttaatccagaattctgtgataagcagcttggctttttttttaaatcaatgcaagttacacattatagccagaatctgtatcacagaggtgcaagctgacagcagagctcagtccccacttcctgcaaacaatggcctgcaccctatcccttgtgtgtgtgacattctctcatgggacaatgttggggtttttcagactgacaggactgcaagagggagaaaggaattttgtcaatcaaaattattctgtattgcaacttttctcagagattgcaaaggattttttaggtagagattatttttccttatgaaaaatgatctgttttaaatgagataaaataggagaagttcctggcttaacctgttcttacatattaaagaaaagttacttactgtatttatgaaatactcagcttaggcatttttactttaacccctaaattgattttgtaaatgccacaaatgcatagaattgttaccaacctccaaagggctctttaaaatcatattttttattcatttgaggatgtcttataaagactgaaggcaaaggtcagattgcttacgggtgttatttttataagttgttgaattccttaatttaaaaaagctcattattttttgcacactcacaatattctctctcagaaatcaatggcatttgaaccaccaaaaagaaataaagggctgagtgtggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacttgggaggctgaggtgggaaaatgacttgagcccaggaggaggaggctgcagtgagctaagattgcaccactgcactccaacctgggcgacaagagtgaaactgtgtctctcaaaaaaaaaaaaaaacaaacaaaaacaaanacaaaacaaaacaaaacaaaacaaaacaggtaaggattcccctgttttcctctctttaattttaaagttatcagttccgtaaagtctctgtaaccaaacatactgaagacagcaacagaagtcacgttcagggactggctcacacctgtaatcccagcactttgggagatggaggtaaaaggatctcttgagcccaggagttcaagaccagcttgggcaacatagcaagactccatctcttaaaaaataaaaatagtaacattagccaggtgtagcagcacacatctgcagcagctactcaggaggctgaggtggaaagatcgcttgtgcacagaagttcgaggctgcagtgagctatatgatcatgtcactgcactccagcctgtgtgaccgagcaagaccctatctcaaaanaattaattaattaattaattaattaatttaaaaaggaagtcatgttcatttactttccacttcagtgtgtatcgtgtagtattttggaggttggaaagtgaaacgtaggaatcctgaagattttttccacttctagtttgcagtgctcagtgcacaatatacattttgctgaatgaataaacagaaatagggaagtaaacctacaaatattttagggagaagctcacttcttccttttctcaggaaaccaagcaagcaaacatatcgttccaattttaaaacccagtgaccaaagcctttggaactatgaatttgcaactgtcataggtttatggatattgctgtggagaagctcaattttcagtgtttgaactgaaccctttcttgttagggaacgtgtgaaagaagaattgtggggaaaaaaaagcaagcataaccaaagatcatcagcagtgaagaatctaggctgtggctgagagaaccagaggcctctaaaatggacctgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctcaaaaaaa

SEQ ID NO: 315357 - DNA, 1693 bp, Homo sapiens
cctccctccagcaccatctcctgagaagcactctcccttgtcgtggaggtgggcaaatctttatcagccactgccttctgctgccaggaagccagctagagtggtctttaaagaaaactgggcatctcctgctacttaaaatcaaaaactacctaaaataaagattataaaaaagtaaggatgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacaggagccagaggaagagatagccatggaggacagccccactatggttagagtggacagccccactatggttaggggtgaaaaccaggtttcgccatgtcaagggagaaggtgcttccccaaagctcttggctatgtcaccggtgacatgaaagaacttgccaaccagcttaaagacaaacccgtggtgctccagttcattgactggattctccggggcatatcccaagtggtgttcgtcaacaaccccgtcagtggaatcctgattctggtaggacttcttgttcagaacccctggtgggctctcactggctggctgggaacagtggtctccactctgatggccctcttgctcagccaggacaggtcattaatagcatctgggctctatggctacaatgccaccctggtgggagtactcatggctgtcttttcggacaagggagactatttctggtggctgttactccctgtatgtgctatgtccatgacttgcccaattttctcaagtgcattgaattccatgctcagcaaatgggacctccccgtcttcaccctccctttcaacatggcgttgtcaatgtacctttcagccacaggacattacaatccattctttccagccaaactggtcatacctataactacagctccaaatatctcctggtctgacctcagtgccctggagttgttgaaatctataccagtgggagttggtcagatctatggctgtgataatccatggacagggggcattttcctgggagccatcctactctcctccccactcatgtgcctgcatgctgccataggatcattgctgggcatagcagcgggactcagtctttcagccccatttgaggacatctactttggactctggggtttcaacagctctctggcctgcattgcaatgggaggaatgttcatggcgctcacctggcaaacccacctcctggctcttggctgtgccctgttcacggcctatcttggagtcggcatggcaaactttatggctgagggaacgtgtgaaagaagaattgtggggaaaaaaaagcaagcataaccaaagatcatcagcagtgaagaatctaggctgtggctgagagaaccagaggcctctaaaatggacctgagtcgatcttcagaacagggatctaccatgcaggagcttcttgtgctcacacaaatctgtaaatgggaacattgtacattgtcgaatttaaatgatattaattttctcaagctatttttgttactattttcctaaaattgaatatttgcagggagcacttatactttttcctaatgtctgtataacaaatttctatgcaagtacatgaataaattatgctcacagctcaaaaaaa

SEQ ID NO: 315358 - DNA, 482 bp, Homo sapiens
tgctgggattacaggcgtgagccaccgcgcccggccatagatagcattttcaatgattatcaacctgtcactgttaaatgaatatttaaaactccctaaagaaatctaaatcaagatgtgtgggaacaattacaggatcacagaacccattgaatttttagagatggaagtattttagagacaatcctagttcctagttccttattttacacagaatctgaagctgaagtttcttgtccccaagttacccagatgactagtagcttaaatcctaggtgtccaaagttttcattgggtactcagtcccccacacaatccagatagcagtgagggagaatgagtggctttagaagcatcataatgtgcatccacactgccaactcatacagagagaaaacgtgacacatctcttcacagaacacttggtacttcaaatgactttcctatacattatctcctttagtctgtagagggttcactat

SEQ ID NO: 315359 - DNA, 2688 bp, Homo sapiens
agcgggtctggcccctcccctccgcccgtcaccgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315360 - DNA, 3467 bp, Homo sapiens
  misc_feature (146)..(146): n is a, c, g, or t
agcgggtctggcccctcccctccgcccgtcaccgcctccttgaagctgccgctgtcgctgctgctcgttcgagtcgcaggtacttggcccggggcctgtgggcagcgcctgggctagagccacttgatatctcctgcaccgtccantgtagcactggaggtccagtaggcctggccggggccctgaggggcgagggtgcccgggcttcccacaccttccgcggcgactggagggagccgggccgaggaagcgaccgcgggtccgtgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcggggggtggagcgcggaagccacgccgcaggtccagctgctcggccggggcgagacggtgctttcgcggcgtgtgcttgcaggagcgcacagttcaggcgccgggacaagctgttggggtgtgagtgagctctccagaatggcacatggctccggggtgcccgggttaaaaggaaggatttgcacaccttccacttagggctcgggtaatcgcaaacttcctcccttaattggcttgcagtgctaaaaagcagatcgttctctctgaggttttcccaacagtacctcaagaaaataacatctgttttttgtaacgttccacggtattcggaattggctacagaacataataagatccttgccagcacattacagaatatttttgttgaaccttcttgagaattcagagaaactgctgagtgaccactgaacgaaaagatctaatcttaaggcttacgcctcactttgatgcccaggctggagtgctgtggctcaatcacagctcatcgcaacctcgacctcccgggctcaagtgatcctctcacctcagcgtcccgaacaggcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315361 - DNA, 2793 bp, Homo sapiens
agcgggtctggcccctcccctccgcccgtcaccgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcctcactttgatgcccaggctggagtgctgtggctcaatcacagctcatcgcaacctcgacctcccgggctcaagtgatcctctcacctcagcgtcccgaacaggcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315362 - DNA, 2033 bp, Homo sapiens
agaggactccctcaatgtggctgacttgacttccctccgggccccactggacatccccatcccagaccctccacccaaggatgatgagatggaaacagataagcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315363 - DNA, 1979 bp, Homo sapiens
agaggactccctcaatgtggctgacttgacttccctccgggccccactggacatccccatcccagaccctccacccaaggatgatgagatggaaacagataagcaggagtttgtggaggatctgggcttctggagagtattgctgttgatcttcgtcattgctttgctgtctcttggcattgcttattatgtgagtggggtgctacccttcgtggttgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315364 - DNA, 1260 bp, Homo sapiens
acacccactgattcagcactttgctcttttaataacacatcgtccacagatctcaaagtaagggttattattttagcttccactcttccgcagacttgagtcatcgacctatttttattgaagaatgaaaggcgatgacaagtttaacatatacaaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315365 - DNA, 1788 bp, Homo sapiens
  misc_feature (146)..(146): n is a, c, g, or t
agcgggtctggcccctcccctccgcccgtcaccgcctccttgaagctgccgctgtcgctgctgctcgttcgagtcgcaggtacttggcccggggcctgtgggcagcgcctgggctagagccacttgatatctcctgcaccgtccantgtagcactggaggtccagtaggcctggccggggccctgaggggcgagggtgcccgggcttcccacaccttccgcggcgactggagggagccgggccgaggaagcgaccgcgggtccgtgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcggggggtggagcgcggaagccacgccgcaggtccagctgctcggccggggcgagacggtgctttcgcggcgtgtgcttgcaggagcgcacagttcaggcgccgggacaagctgttggggtgtgagtgagctctccagaatggcacatggctccggggtgcccgggttaaaaggaaggatttgcacaccttccacttagggctcgggtaatcgcaaacttcctcccttaattggcttgcagtgctaaaaagcagatcgttctctctgaggttttcccaacagtacctcaagaaaataacatctgttttttgtaacgttccacggtattcggaattggctacagaacataataagtatttctacccatggcaaattccaccacaccgtcaaggctgagaatgggaagcttgtcatcaatggaaatcccatcaccatcttccaggagcaagatcctaccaaaatcaaatggggtgatgctgaagctgagtatgccgtggagtccactggcatcttcatgaccatagagaaggctggggctcacttaatgggggagccaaaagggtcatcatctctaccccctctgctgatgcccccatattcataatgggcatgatccctgagaagtctgaaaacagcctcaagatcatcagcaatgccttctgtaccaccaactgcttaatcccccggccaagcccatccatgacaactttggcattgtggaaggacttgtgaccacaatccatgctgccactcctgcccagaagactcgatggcctctgtgggaaactgtggcatatgtctgtggggctctccagaacatcatccctgcatctactggtgttgccaaggctgtgggcaaggccatccccgagctgaacaggaagctcactagcatggccttccgtgtccttctgcaaacgtgttggttgtggacctgacctgccatctggagaaacctgccaaatatgatgacatcaaaaaggtggtgaagcaggcgtcagagggcccctcaagggcatcttgggctacactgaacaccaggttgtttcctctgactttaacagtgacactcactcttccactttcgatgctggggctgccattgccctcagtgaccactttgtcaagctcatttcctcgtacaacagtgaatttggctacagcaacagggtggtggcccatatggcctccaaggagtaagactgctcgacaaccagccccagtgagagcacaagaggaagaaagagaccttcagcttctgggcagtccctgccatgctcagtcccccaccacactgggaatctcccctcttcacagtttccatgcagaccccacaaagagctctatcttgtcgtgtaccatcaataaagtcctctgtactcaaaaaaa

SEQ ID NO: 315366 - DNA, 814 bp, Homo sapiens
gtatttaatagaacagtgagttctttttctcaccacacttctattataacttaattttctatttactgtagatccttgccagcacattacagaatatttttgttgaaccttcttgagaattcagagaaactgctgagtgaccactgaacgaaaagatctaatcttaaggcttacgtgagtatttactactgtggacttcctcacaagatgtgaaaccttcagtgaactgctttaggacagattcagttctgtgatcaagatgaaaaataactatcattgggcttattaaatgtgggattaagtttagtagttgctcagggacacagagaaactgacaaaatacacacttgttctcacctgaaaaatagacacagagacttgtatttcttgctgagccaacactcagaagtatcctagtctgcaaaccacaagaattcttactgtgtctgaatcaaaaacaccaactagattttttaaattatctatttttaaaaatttaaccaaaacacattaccttttgaaaagcacttgatatgtggcatttcattttgaaaaaggtttatgatagcttttccatttttatgattcaatactgtgcaagcttgtccaacctgcagcccagaacagctttgaatgtagcccaacacaaattcataaacttttaaaaaacattctgagattttttttgcaattttttaaagcttatcagctatcattatgtattttatgtgtagcccaagacaattcttcttccattgtgacccagggaagccgaaatgttggacacccttgctgtaagggaaaatatttagat

SEQ ID NO: 315367 - DNA, 3362 bp, Homo sapiens
  misc_feature (146)..(146): n is a, c, g, or t
agcgggtctggcccctcccctccgcccgtcaccgcctccttgaagctgccgctgtcgctgctgctcgttcgagtcgcaggtacttggcccggggcctgtgggcagcgcctgggctagagccacttgatatctcctgcaccgtccantgtagcactggaggtccagtaggcctggccggggccctgaggggcgagggtgcccgggcttcccacaccttccgcggcgactggagggagccgggccgaggaagcgaccgcgggtccgtgatggcttcttcgcggtctgtgtgttcacgagggccgggcagaggcctgcgagggttctcgtttgcgcttgcgggttagggctgtggtccggggaacccctgggcagcgcgggcagccctggctcgcggttaatcggggggtggagcgcggaagccacgccgcaggtccagctgctcggccggggcgagacggtgctttcgcggcgtgtgcttgcaggagcgcacagttcaggcgccgggacaagctgttggggtgtgagtgagctctccagaatggcacatggctccggggtgcccgggttaaaaggaaggatttgcacaccttccacttagggctcgggtaatcgcaaacttcctcccttaattggcttgcagtgctaaaaagcagatcgttctctctgaggttttcccaacagtacctcaagaaaataacatctgttttttgtaacgttccacggtattcggaattggctacagaacataataagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315368 - DNA, 2585 bp, Homo sapiens
agcgggtctggcccctcccctccgcccgtcaccgcctccttgaagctgccgctgtcgctgctgctcgttcgagtcgcaggcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatgtgagtggggtgctacccttcgtggaaaaccagcctgaactggtgcattaaaggagctcatggaagatgaggcaattaattgcctgtttcctggcttccaatgtttgttctcagtttctcagaatttttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgtaggaaagcctacacgtagccttgtttgataaaaacacggaagtgactagagaatggaagataaaggaagaagctaggaagtccttgctatcaaaaccttatcctaatataggaccaattgaagtattcaaaaagaaaaacagtatcttatatgattagtttttgttggtggttttgttttcatttatttttgcaagagccactttttatttactttctctagggataagagataaaacttgaagtacttttttcaaatcttgtgtgcaaattagtattgttagcatctatttggcttattttagtatttttaagtctagtcacaaaccaaacaaaacttttgaaaatgagctatattttgttcaaagataattgatttgatcttatatttatttgtttttaggataatttttgatctttttgtaaactgctttgcttgttaatatctgtgaaaaataaatgagttcattttgttcactttccaattttcccgagtatcctagtcatcaaagataacagttcatcagaattacagtcagaaaatcctttttctactgaatagttagcagggaaaaataattctgatatttaactgtcataattctgtagtgctattatagtgaaaaactcagttctataagctagctgtgttgtcacagttttatcatagttcataattatttcatgtgcaatcctatttggaggccctgttagacttttaacaatcccatccatatctgtaattctctgatggcaagaatggatggagcatttctgagttaacagtgctggacagtatcgtactgggtgtcataaactctttatgaatggtaatattatgtaaattgaaatctggccctcaaactatattgcagctttcagcagtatgtttgaaggcctcttttgttaatgattctgtaatgtatgaattatgttcttgagtggttaaaaaagaatatgaaggcttgataattatttattgggtaaagtcaggaaattgtagtgaaagaactaatggttttgttttttggaataaaggcacctaagctattgctaattgaattgctgctagaattagaaattatgctttagaatagaattggtatttctgtgattctttttgcttcttggtattttctcttgtatctatgtatctagtattgaggcttgctctttcatgtggctttatcctctctttaatagctgttgtaaaattcctgagtaactggctgcttcaggatcagcttgcagagtcttgcttttaggttagatacaaacaaagtaaatcatagttggtgtaaatccagcaaaaaacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgattt

SEQ ID NO: 315369 - DNA, 1739 bp, Homo sapiens
agcgggtctggcccctcccctccgcccgtcaccgcctccttgaagctgccgctgtcgctgctgctcgttcgagtcgcagatccttgccagcacattacagaatatttttgttgaaccttcttgagaattcagagaaactgctgagtgaccactgaacgaaaagatctaatcttaaggcttacgcgtgttccatccaccacatcagaacaatgtcgtatgtttttgtaaatgattcttctcagactaacgtgcccttgctgcaagcctgtattgatggggactttaattattccaagcggcttttggaaagtggctttgacccaaatattcgtgacagcaggggcagaacaggccttcaccttgcagcagctcgagggaatgtagacatctgccagttactgcataaattcggtgccgatcttctggccacagattatcaaggaaacacagctcttcacctctgtggccatgtggatactatccaatttttggtttccaatggactcaaaattgatatttgcaatcatcaaggtgctacccctttagttctggcaaagcgcagaggagtaaataaagatgtcatccgattgctggaatctttggaagaacaggaggtgaaaggatttaacagaggaacccactcgaaactggagaccatgcaaacagctgagagtgaaagtgccatggaaagccattcactcctcaatcccaacctgcagcaaggtgaaggagtcctctccagcttccgaaccacgtggcaggagtttgtggaggatctgggcttctggagagtattgctgttgatcttcgtcattgctttgctgtctcttggcattgcttattatagaaggacactgaggcttggaagctttgcaaggcaagacagaagccgaatccaggccatctaatctctaggtcagtgtcctgtgctcctgagcctcagaaggcaagaaagaagggatacagacgtcagcgtccctgttgggtggggctgtttccgtcacgacttgtgtcatggagcatcatctcaaagctctgcagttaggaggcagagggacctgctaccacctgtcccctcctctccagtcctgccctgcaggcagcccgggcacctgctgtcttcctggcctcccagatcctcaagatggagctccaggaaccatcccctcctccgcccgggcaggatgccacttccacaaggcaaatcacatccatttgatcttgaacaaaaggctgccgtggtgtctgaaatgacaactcccaggcgggtgatgtcatgctgttttgtttgtctccatggactgtggggatccaatttcagttgtgaagaaaacggtctggggaaaaaagttacttcattcggaaaattccgagaagccataaatacagtttgcagctgaggaaagcactttcacactcagacaatggatttgggtggaagaaaagacttcccgcccctaaggctgagccccttcactcccacccatggccaccggcagcccgcttctgccagcagatagatgtgtgcatggctctggcaagatctcaagcaaccccccttccccaaggagactctccgtgacccagtggcaagttggcaggggatgtgttttccctggttctcatcctaaattgtctcctgcccagagtccatccctgaagtatcaggcacttccctctcgtaaatggttgacctgcatctctgagctgctgttaaagcaaatttaaaataacatttt

SEQ ID NO: 315370 - DNA, 10372 bp, Homo sapiens
  misc_feature (5)..(5): n is a, c, g, or t
  misc_feature (82)..(82): n is a, c, g, or t
ccttnttccaagggattgaccagcttatgaaggtattaaggcttaaccatgatggccaaattttagatcagacccatttggnacctctggaaagaaagagagagtagagaatcaatgtaattttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 315371 - DNA, 10330 bp, Homo sapiens
cgaccgaactggagaatccgccccgggatgtggttcgtaggggtgtctgcgcccttctgctcgggttcaaactggtctcggattagtgtcccagaccctactcggtcacggactcacactttaggggatcattttcttcctccgtaaaagaattggagatgactagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 315372 - DNA, 1893 bp, Homo sapiens
tacaatatatgaatcttatatcttataattatttttccatatgcttataaaaagaaattcaaggttttaaatggaattacttttattttgtagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 315373 - DNA, 9817 bp, Homo sapiens
  misc_feature (9797)..(9797): n is a, c, g, or t
tgagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggggtgtataccaccaccactacttgggaggctgaggtgggaggattgcttgagtctgggagatcaaggctgcagtaagctgtgatggatcactgcactctagcctgggtgagangggaccctgtctccaaaaat

SEQ ID NO: 315374 - DNA, 9433 bp, Homo sapiens
  misc_feature (8659)..(8659): n is a, c, g, or t
  misc_feature (8733)..(8733): n is a, c, g, or t
  misc_feature (8948)..(8948): n is a, c, g, or t
tgagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaaggaacaatgaaggtgaaccctagtctcaggattgctagtctcaagatggtaccactgtaattctacctggaaaaggaggtgttttcattcctacagatatttttcataagataaatacccacagtgtatagtaatgaacctggataataaatatcttccagnaaatattttacttagaagacgattatattttttaaattttgagattaattgaatatatacaaacagaaaattangtacaaatttattatgtttatggctcttatacaactatcaaggtaaaggaaatttaccaattaaatacaaagtagtaaaattcaaaatcacaataattaataatgttctgctgctacaaaatgagatgttgggtttaataatagaaggaagtagcactgttgaaatagaattaaatgggtcttgaattcatttgtgattggaatcagaagtcgcnagttctgaaagggtaaggtttactgcaacattgctaataaataatttcaagatgaaatatacaaagatgagatccaagctctaacatttacttgcaacatgaatatggtactgtgttcttctccgtcccccatcctcattccccctcctcctcctgctgctgtttggtcttcctttggaaattcatgatgccatatcagatggttttagaattctgcactttaataatgtaatgcatatgccatatataatatcccagagggatctgctataatattgcataatcgaattcatatttctgcagcaaaatgtgtggatactctcacaaggcaggataaatagagactatatatactgggccaggtgtggtgactcatgcctagaatcccagcactttgggaggccagggcaggaggatcacttgagaccaggaatttgagaccagcctgggcaacatagtgagacctcatctcttaaaaaaaaaaa

SEQ ID NO: 315375 - DNA, 970 bp, Homo sapiens
  misc_feature (20)..(20): n is a, c, g, or t
  misc_feature (68)..(68): n is a, c, g, or t
  misc_feature (350)..(350): n is a, c, g, or t
  misc_feature (352)..(352): n is a, c, g, or t
  misc_feature (354)..(354): n is a, c, g, or t
aaattcccgatttttttttnaaaaagcaatgcatgagataatagcaaattccatattgcctactatcnaatgtacctaacaaaaagtggctttgttaggcatttggaaaataatttatttactgaagaactattacttttaattgttccttacccgactcgaaagagtcccataataccctgccttaggtacggaaaattagaccctggtgtggtgactcacatctgtagtcccagcacattttggggccaaggtgggaggatcacttgagccccaggagttccagacaagcctgggaaacatacggatactgcatctctacaaaaaatttacaggaaaaaattatctgngngntgggtgtataccaccaccactacttgggaggctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 315376 - DNA, 570 bp, Homo sapiens
ccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtaaactactgtcaacatccgtctactgtttgagatccagaaaattgcagtagtacctgggtgaggattggacactgcacccccgattcaggagcgctttcaaaaagtctgaccttcttggtgtggtgtaagtcagtcagtagtgagcaagtgaccgggtgagcattacagtatcagggtacatgatctcatccttcagtcaacaggccgcttatatgtagtttgatggaaaatggcattgttacatcaaaactcagtggatttctaagaaagtttcaggcgttactgatgaaggatttgaagaggtaattttccctttcgccactggtattagtcattgtttgtttcaaactttactctcacttatctgcccccagctgctaattctttattgtttttattaatcctttactttcttaaaaa

SEQ ID NO: 315377 - DNA, 2114 bp, Homo sapiens
  misc_feature (1340)..(1340): n is a, c, g, or t
  misc_feature (1414)..(1414): n is a, c, g, or t
  misc_feature (1629)..(1629): n is a, c, g, or t
ctggccacagtatgaggtgttttctaaggcttgacattaggtatttcctagtgcaaaatttactgatcccgcgtaggctccaacctagagccaggattccttaatggaacacaaactgatttactttgaatatactcaagcttcacagcaaacacttcctgtttctattactgtccaagtcttcttaccatgcctgaggcagacaatttaaggcttgattcctcaccctttcccttcatctgctgaaatcccatttagttttagtgcaccaggcatgcactggtatttcatcctatgcattccttccacagcctgacctataaagggctgacactgagtcctggcttgttcagatcagagagaattaacacttttatttctttgatttcaaaagcttctgaggtaacttttgagctcgtaaatgtcaataatttgttgtcaagacaattatattcttaacccagctgctacatatagggaacatagagactgacagaaagtcagtgaatttagaattaaaacagtaagtttatctgattgactatgcttctcaaaatgtaaatggatgatacaaattaatacaaccaattcattttatttggtttggttttggtttttgaatgggtttatgggtttaagagacattgctctctgttgtttatgtgtattcagtgtcagaaaggaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaaggaacaatgaaggtgaaccctagtctcaggattgctagtctcaagatggtaccactgtaattctacctggaaaaggaggtgttttcattcctacagatatttttcataagataaatacccacagtgtatagtaatgaacctggataataaatatcttccagnaaatattttacttagaagacgattatattttttaaattttgagattaattgaatatatacaaacagaaaattangtacaaatttattatgtttatggctcttatacaactatcaaggtaaaggaaatttaccaattaaatacaaagtagtaaaattcaaaatcacaataattaataatgttctgctgctacaaaatgagatgttgggtttaataatagaaggaagtagcactgttgaaatagaattaaatgggtcttgaattcatttgtgattggaatcagaagtcgcnagttctgaaagggtaaggtttactgcaacattgctaataaataatttcaagatgaaatatacaaagatgagatccaagctctaacatttacttgcaacatgaatatggtactgtgttcttctccgtcccccatcctcattccccctcctcctcctgctgctgtttggtcttcctttggaaattcatgatgccatatcagatggttttagaattctgcactttaataatgtaatgcatatgccatatataatatcccagagggatctgctataatattgcataatcgaattcatatttctgcagcaaaatgtgtggatactctcacaaggcaggataaatagagactatatatactgggccaggtgtggtgactcatgcctagaatcccagcactttgggaggccagggcaggaggatcacttgagaccaggaatttgagaccagcctgggcaacatagtgagacctcatctcttaaaaaaaaaaa

SEQ ID NO: 315378 - DNA, 10298 bp, Homo sapiens
tgagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 315379 - DNA, 10620 bp, Homo sapiens
  misc_feature (10328)..(10328): n is a, c, g, or t
  misc_feature (10496)..(10496): n is a, c, g, or t
tgagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaaaaaaaaaaaaaaaaaaaaaaaaaaattttnggggggttgggttgaaaaagtttttaaaacatttggtggggggggggggccgggtttggggcacacgtggcgcaaaagtggtgtgccaaagagaagaagccgcggcgccagggactagggctgtcgggggtttttctccaccaatataaaaagaagcccgcggggggnagacccgaaggtgtttctgggaacaaattcccgagtagggggttcccggagggcacatcacggttgcttactcaacaggggtgcccaggggaagccgatataaaaatagcagggcgcggggggc

SEQ ID NO: 315380 - DNA, 10220 bp, Homo sapiens
tgagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaagatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtggaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtccccagccccaaagctggactggagtccaagggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaa

SEQ ID NO: 315381 - DNA, 5302 bp, Homo sapiens
  misc_feature (5023)..(5023): n is a, c, g, or t
tgagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaaaaaaaaaaaaaaaaaaaaaaaaaaattttnggggggttgggccccgggaaagtttttgaacccttgggttgagccgcggggcccaagagggtacggctaacaatgggcacatagaggtaccacaggaggacaccgggggcgacgcaacaagaagggcgtgagaattccacacccaaataagaaagacgccgggggggaaaacacaggagcgtctcgagaacaaaccccaaagagggaacaacgagaggcacaatcggggggctcacatcacagggaggtccacaggggagctcgaattcaatttacgcg

SEQ ID NO: 315382 - DNA, 457 bp, Homo sapiens
  misc_feature (457)..(457): n is a, c, g, or t
cgcggaggctgggaactggcggtctgacgcggcgaggtgaaaaatcaccttgggggcccaggttccccacgaacagctaattctcaggtacggaatgggctctggagggccgcgaggtgagcgtgcactgtcaggaaggtgcagcacgagtcttcgggcttcagggacaggggaatctgccccctacacccctgctcggccatttacctagaaccaaacagcagccaacctcgagactgattctgacagcaccaggagtaatgaagttctctaaattcgataaactattgaaatttcccttcttcctttcccataatgcccaaacgacgctgaatcggcagcagaatgcaggactttggcctataatcaatgcaaaattcattttgctaagctacgtaaaagctataaatatcactcccctacacagataataaaccttggtagcctaaaaaaaaan

SEQ ID NO: 315383 - DNA, 545 bp, Homo sapiens
gtttatctagacttcaatgttcacttaaagttttaatataatcctttcccaatgttattgaaaatgagagtattcattatgtactttttaaatgttatatttaaacattccaaaaggcctgaaaacaatttttattgacaagcaggttttatataagttactggcagtagattattctctagtcattgatattgaatttgtgatttataggcttaaaggcaaaactatactacaggaaacatttcaaccattaagtatgcagttttgagacgagacagaatattcctttagttcattcatttgtccctacactcgacaaatatttattgttgacttaatccagactaagtactgagaataggatgagcaaaactacacagctgctaccccgtagagcttataatctagtcaagggagacagacattaatcaaacaatcaataaagtaattgaaagttgtaaatgttaggaataagaggtatatggtcatatacgtcactattcaataaaaggagctgttcaagactaggatgtgtgtgtgtgtgt

SEQ ID NO: 315384 - DNA, 391 bp, Homo sapiens
cgcggaggctgggaactggcggtctgacgcggcgaggtgaaaaatcaccttgggggcccaggttccccacgaacagctaattctcagttctggcaggctggaaagtccagggtcaagatgctggcatttggtctgataagggccttcttgctatctccttacatgacagaagacagtcgaacaaagtgtacaattgctgagagatagaagcaatgcagccccagaagaggaagaaaaatgacaggaaatcccgatccacacttgaccaaaatcatcaaacaatctaggcaactggttttcactcgtatgatagttttttaagttgtcagcaattcttggcaaatacaagaatagaaaataacttcagtaaaactctgagctaaaaggctta

SEQ ID NO: 315385 - DNA, 742 bp, Homo sapiens
cgcggaggctgggaactggcggtctgacgcggcgaggtgaaaaatcaccttgggggcccaggttccccacgaacagctaattctcagttctggcaggctggaaagtccagggtcaagatgctggcatttggtctgataagggccttcttgctatctccttacatgacagaagacagtcgaacaaaggcaagttagccaaaccctgtgtgaagcctcttttataaggaccttaattccactgatgaaggagcagccctctggcctaatcaccttttaaagaccccacctcttaatactatcacattgacagcacccaaattttggagtgacacattcaaaccacagcagacaacaatggcttattagcttggtgcaaaagtaattgaggtttttgccattacttttaataagacagatgtagaagataagtttcaaaccaaagtcagacaggtagctgcaaatacatcaaaatgaaaattcaacaaagaaaggaattgttgcttattttattataatctcatcctcttagcctaaaacagtgcctggcactttgtagttgctcagtaaataattgttagataaatgaatgaagtttccctctataaattccagaaatatttgagaaaattttaaagataatttttgttattataaagcaatgttttactgtaaaagtgaagactatattgatataaatatataagcatagacacaaaatgattaaaattgatcataatcctac

SEQ ID NO: 315386 - DNA, 2038 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315387 - DNA, 371 bp, Homo sapiens
  misc_feature (186)..(186): n is a, c, g, or t
ttatctagaggatcaccttcatgtcagtgctttcatgcaggtggccaggagtacccatgcacatgcagtgtggggtgtgggcatctcaggtggtgttctggtaaaatgttagaatagctgtatgaaggaaaccagtgggaggaaatgaagttttcgggatgaagggcctggacatgaatcatgtcnagggcattccatcccttcctgaagggggacactccatgagtgtctgtgagaggcagctatctgcactctaaactgcaaacagaaatcaggtgttttaagactgaatgttttatttatcaaaatgtagcttttggggagtgaaggcactcgacatgaagggatcctctagagtcgccagcagcatc

SEQ ID NO: 315388 - DNA, 498 bp, Homo sapiens
taccctgtgtttaaggatccggcgttgctgtgagctgtggtgtaggccagtggctatagctccgaggcatgaagggactcgacatgaatggggcattccatcccttcctgaagggggacactccatgagtgtctgtgagaggcagctatctgcactctaaactgcaaacagaaatcaggtgttttaagactgaatgttttatttatcaaaatgtagcttttggggagcatgaaaggtctcgatatgaattcatgtcgagtcccttcatccccctgacctcagccttctccaaggaacccccaccgcccgagcgcatctctggctgtctttccatcttgagctgggtcggcctctccactaaatccatccactggcatgacttcagccaaacttcatcggtgtttccagagtcagatctatggatgggcaacggggcggtaagacaagaagtacaggaacagtgatccaatgtcatggcatgaaagcactgtatatgaa

SEQ ID NO: 315389 - DNA, 1681 bp, Homo sapiens
gaattccgggtgcatggggtgtggcacacaccctaacctgtgcattcaccttggccacacagccagccccacatcctacaaacaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315390 - DNA, 2354 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggtgagttggactctccttttgccacctattccccgtccgctctccagccccttcccctggtcccagattgcccacggcaggaaaagttaaaaagttcgcgatcgtttgcgggtagccgtttctttaagcactctccccctccccccgaagacgtgtcgggacctcttggtgggagcagccttccgaggtggccgggctggacgagatcagaggctccccgtcgatagggtcggagaccccgtccctcactgcggcagccgcggcgcccctcctgcgcaccgcgccgagtctcacgcgtatcttctcccccttccaggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315391 - DNA, 2703 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggtgagttggactctccttttgccacctattccccgtccgctctccagccccttcccctggtcccagattgcccacggcaggaaaagttaaaaagttcgcgatcgtttgcgggtagccgtttctttaagcactctccccctccccccgaagacgtgtcgggacctcttggtgggagcagccttccgaggtggccgggctggacgagatcagaggctccccgtcgatagggtcggagaccccgtccctcactgcggcagccgcggcgcccctcctgcgcaccgcgccgagtctcacgcgtatcttctcccccttccaggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagaggtaagatgcttgtggtttggcccctttaaaaaaaatactagtccccatagtccagaagtttagtaattctgagaccatgtatggtgatgctttgttgttggtagcttggcagaaaggcacatgatttcagcagtctggaatgcaattcagtgtgtctgggcccaacgaaagcgcatacggaaaagtgattcctgactaacttattgttctggtctggagtctccggggaattgtagggaactttaccataaattgaatttaacagcagaaaatatgtatgagtttcaggcggtggtttggaatcttaactttatccccttctacctttctcttttggtgatctttgcagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315392 - DNA, 2352 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaagaaaacagcgcttcatgttcatcagaatataaagcctaagggtctccatcactctgt

SEQ ID NO: 315393 - DNA, 2168 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctggtaagtggagactgagcacttcagacactgtactgagatgcatttctggtctaaatctttgtagaaatgagtgcttgagcctgtttgtgtcggtatgcctctgagaagtcttccctcttatatgtctctatttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315394 - DNA, 2153 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaagtaagttccttcagggacgtgtagactgttgcctggcaggtgggtgggatgtgaacatctttttgaagaaagagaaatatcacccctaactttccttctctcctttctcttacagaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315395 - DNA, 1936 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315396 - DNA, 2283 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctggtaagtggagactgagcacttcagacactgtactgagatgcatttctggtctaaatctttgtagaaatgagtgcttgagcctgtttgtgtcggtatgcctctgagaagtcttccctcttatatgtctctatttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaagtaagttccttcagggacgtgtagactgttgcctggcaggtgggtgggatgtgaacatctttttgaagaaagagaaatatcacccctaactttccttctctcctttctcttacagaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315397 - DNA, 1958 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagacgcgtcaaaatcggtaactctaggtca

SEQ ID NO: 315398 - DNA, 1763 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcatttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315399 - DNA, 2174 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaaatgagtgcttgagcctgtttgtgtcggtatgcctctgagaagtcttccctcttatatgtctctatttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaagtaagttccttcagggacgtgtagactgttgcctggcaggtgggtgggatgtgaacatctttttgaagaaagagaaatatcacccctaactttccttctctcctttctcttacagaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315400 - DNA, 1457 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccatatctaacaacgtaaaaataaaatgacagtttgaacatttcaaaaacccacccattcctccccacaatcatcgccttacacgctaatcctactattccccttttatactaatatcttattaaaaaaaaaagaagcggcaccaaaaacaaaaaaaccgggggtttttggggggggcgaaaaggagaagggggccggttcattgttccccgcccctttgaaaggggacacgggccccaagggggtaagaaacg

SEQ ID NO: 315401 - DNA, 592 bp, Homo sapiens
cgtgtgactcttgaggatccccttcatgtcgaggggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaagaaaacagcgcttcatgttcatcagaatataaagcctaagggtctccatcactctgt

SEQ ID NO: 315402 - DNA, 746 bp, Homo sapiens
  misc_feature (186)..(186): n is a, c, g, or t
ttatctagaggatcaccttcatgtcagtgctttcatgcaggtggccaggagtacccatgcacatgcagtgtggggtgtgggcatctcaggtggtgttctggtaaaatgttagaatagctgtatgaaggaaaccagtgggaggaaatgaagttttcgggatgaagggcctggacatgaatcatgtcnagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaagaaaacagcgcttcatgttcatcagaatataaagcctaagggtctccatcactctgt

SEQ ID NO: 315403 - DNA, 2481 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaaaaaaaaaaaaaaaaaaaaaaaaaaaaaaaaaaaaaaaaaaagagagagagaagaaaaaaaaaaaaaaaaaaaaaaagaaagaaaaaaaaaaaaaaaaaaaaaaggggaggggcggggaaaaggggcccccaaatgggaagcacaaaaaacaagagcagacataggtactggtaaaacaaacgagcacagaaaaagggagaaatcgaacaagcagggaacctctggaaggaccccaaaacagcgggaggggggcaaacaaaagagggaagaagaaaacaacagaggaaagagagaaaagcaaaccactccaaggagggaagaagagaacaaaacgacaaacggactaaaccaggagcggacaaaaaaaaaccaagacagagagaggcggacaacaaacaacaatccgaggccaaaagaggcagaagaaaaaaagaagaaaatta

SEQ ID NO: 315404 - DNA, 1570 bp, Homo sapiens
  misc_feature (31)..(31): n is a, c, g, or t
ggactcccggcagaatacactcaaagggatntgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315405 - DNA, 2281 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagcta

SEQ ID NO: 315406 - DNA, 1470 bp, Homo sapiens
gctggactgtctgtatgtgtcacgggacagtgtatcgagtggtgcagtgcgctgtcttggtcggatgttcgctaagactgccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315407 - DNA, 1985 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaattacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315408 - DNA, 1968 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaa

SEQ ID NO: 315409 - DNA, 1977 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagtgaaggcactcgacatgaagggatcctctagagtcgccagcagcatc

SEQ ID NO: 315410 - DNA, 2313 bp, Homo sapiens
agcggagaccgcgagcgagagcgcccccgagcagcgcccgcgccctccgcgccttctccgccgggacctcgagcgaaagacgcccgcccgccgcccagccctcgcctccctgcccaccgggcacaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggatgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaagaaaacagcgcttcatgttcatcagaatataaagcctaagggtctccatcactctgt

SEQ ID NO: 315411 - DNA, 1932 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315412 - DNA, 955 bp, Homo sapiens
  misc_feature (17)..(17): n is a, c, g, or t
  misc_feature (19)..(19): n is a, c, g, or t
  misc_feature (24)..(24): n is a, c, g, or t
  misc_feature (39)..(43): n is a, c, g, or t
  misc_feature (49)..(49): n is a, c, g, or t
  misc_feature (52)..(52): n is a, c, g, or t
cctaaggaaacactttnanaggcnacagaggggaatttnnnnntaagtnaanatggaagaagttagtgggtttaacagatatgaacaactgagtttcctttgggggagaggcaatgaaaagagccggagtactttagggatcactttggagaggatattgtagtgggggaaaggaaggtaaaaacttaggaagcagagtagtacctttaaagtcgtcagtactttatataccatcaactgggctatggacaacagaagctgtgcctggaaataactcacactgaaggttaacttgaatataaatttagaacagatcttaaatacaaatgatgatgttcattataaactgttattcttcaaagactcatttaactgaagtaacattgtatttgcataccagagcactggtgtttttcaaaatgagtttaggataagaaaattcacttgaaaagctggagtatgtatgtattttgcgccatcatggattttatcataagcagtgttcaagaaaacaaattacttggggaggtggggaccagcagataaatcccacccttccttgagctgtcgctgtactctgaagttcagccagctcagattttataaaaattaattaaaatctcaaaaaaaaaaaaaaaaaaacaacaaaaaaaacaaaaaaaaaaaaaaaaaaaaaaaaaaataaagagaaccacaacagaaaaagcacaaaaaaaaaaaagaaagaggagggagatcataaaaaacaccgaggggaagcacggaggagtgagcagaaattgagcaaacgagacggcgcgcacagagggagcggaagcacaaagagagagagagcgactacgaaaaacacaagacgagagagaaaaacaagagagaagggagtaaggggagagaacaacacgagggggagaaacaaagaggaaaaaaagaaagaaaaaagagcgcggagaacaaa

SEQ ID NO: 315413 - DNA, 742 bp, Homo sapiens
ctgcccctgcccatctgtcacccacctgctccgtttgacccctggacttggtatacctccatgtggagttgttgggcgagaggtgttctctgtgctgtgaattcagtggggagctgtagcggggtgggggctaggttcctccccccttgggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgcaatgtgctctatgcctttgacgtcaatacgcaacaagtggttcacaccccgagtgtcagggacatgttcctggggcccgggatggacattcagcctgtgtcctagggcaagatcatgtacatttttgggggctacgagcagcaggcggactgtttttccaatgacattcaacaagctaaataccagacatgaactggctctattcggtcaagggcagccgggccgctggggggttccctccggcccaagtgggagtccatgtgttctg

SEQ ID NO: 315414 - DNA, 1985 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaaaaaaaacacagacaagaaacttcagggcacacaaaaaacgggtggggaaaagg

SEQ ID NO: 315415 - DNA, 1560 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315416 - DNA, 1766 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacttggggaggtggggaccagcagataaatcccacccttccttgagctgtcgctgtactctgaagttcagccagctcagattttataaaaattaattaaaatctcaaaaaaaaaacacagacaagaaacttcagggcacacaaaaaacgggtggggaaaagg

SEQ ID NO: 315417 - DNA, 1459 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatttggggaggtggggaccagcagataaatcccacccttccttgagctgtcgctgtactctgaagttcagccagctcagattttataaaaattaattaaaatctcaaaa

SEQ ID NO: 315418 - DNA, 1606 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtacagcgagtggttggaagggagggattgagtgagggtgagtgagcagcacaggtgtgacctgattagcttggtttcagtatggaggagacagacatttttgttctgctggagatgtagtgtacttgtgggaaatgagatggaaggaggtgaattgacagccatcatataaaactgtcagcagaataaattatatgaaaaaaaaatacagctcggcagcatcactttctgagacctaagcttatacagttatttttgtgaccatgctgagaacaactgattaaatcttagaacctagctgc

SEQ ID NO: 315419 - DNA, 1135 bp, Homo sapiens
  misc_feature (963)..(963): n is a, c, g, or t
  misc_feature (968)..(969): n is a, c, g, or t
  misc_feature (982)..(982): n is a, c, g, or t
  misc_feature (1003)..(1003): n is a, c, g, or t
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggccttggtacantgggnnctgtcatcttggnggtatatgcaagctgaacggnacttcatgactctggagttaatctgtgtctttactggaaagatgaacgaggaaagggcatgtccgcgggacaagctcgatgatgtgggccaatgcctctgggaacacatcgagaagcgggaaatggcagaga

SEQ ID NO: 315420 - DNA, 1204 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatgggggtgtgaaccacttgtgcgtattgacgtcaaaggcatagagcacattgcaggccccttcggtgtcattccgcccgccccaaaggaggactgtgtcgtcgatgaggacggttgagtgtccatagcgcatgtagggtaccacaggagcttgcccacggatggcagacttcaccgggggcagctttgtccaacgcaaggacatatgcattgaaaaatgtgcacagtccagtctagctc

SEQ ID NO: 315421 - DNA, 1938 bp, Homo sapiens
  misc_feature (9)..(9): n is a, c, g, or t
gagtcttgngctagtgctttactctacagttagggtgacctaagggtcgctcgcgttaggacgcgcaatcgtgtgttctacggcgtgctagcgcagactcgcatggacgccgctggccccagcctccggcctctggtgccctgtgtcagatacgcaagcatgtgcatgcagggccgatagccgcgggcgagggacatagttcgtctgctaaaccagctggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315422 - DNA, 1003 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggtgggtggtgccccgctccaggtgctgaggggcccggccctcgcctggtccagggggcgcccccggggtaggcagggacggtccacccgagtccggcttcggaaagagg

SEQ ID NO: 315423 - DNA, 1816 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcagcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315424 - DNA, 1755 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315425 - DNA, 1263 bp, Homo sapiens
tggctagtacgaggctgcgtttgaatcggcagaggctcgtgccgatgatcatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315426 - DNA, 1614 bp, Homo sapiens
agtttaggagcctctggatcacattggttccagaagatctggctgcttccctttgaatttcgttcttaggttccaattaaccaccagatgttactttatgtataatttttcaggttcaaattaaccaccagatgttactttgtatataatttttcctgtctgggtcattctgagatacttcgtctctttgtatcagttcagtttaactcttgctggctgggcatggtggctcatacctgtaatcccatcacttcgggaggttgaggtgggcaaatcagttgaggtcaggagttcgagaccatcctggccacatggtgaagccctgtctatactaaaaatacaaaaattagctgggcatagtggcagccaccagtagtcccagctacttgggaggttgaggcaagagaattgcttgaacccgggaggcgggggtttcagtgagtcaagattgtgccactgcaccactgtactccagcctaggtgacagaacaagactcaaaaaaaaaattaatatggttgggtgggtggggaaggcctcaggaaggataggagtgctgagtcagagccttaaaaggatgggagttaagagcaaaaatgggtattcctggtggggtgaggcattcctggtgagggtaaggtggaggggctgcctggttggctctaagcaaagcaggaaaggcaggttgggatgttgactgacatgtatacacagatctcaggtgcctggacactgcaatatacatacatacataaacataaaccggaaatccatatgagcttggaggtagaggagtgggtggtgttggatttggtggtgggtgggttctgattgttcaacctagtaggtctcttaagtaagaggtggctgtgggtggttgacctttaggaagttggagagactggtgtgtttttagcttggttcaaacatcccttagcttgggctgagggccccctcttctttctgtctcttattgttggccttccaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315427 - DNA, 945 bp, Homo sapiens
gtccaccaacgattgaactcgttggccaacgggccatgtgcccgcccgttcgcccgggtgcttgttttcagttgattggtcgacaagattagtcctctttgagtgtgatacccaagtcccaatctcctttgacggacacggcctcggtcagcatcgacatttcgaccgctttgtacgactcgaatctcgtgccgttctacgccgagtttatcggacttgcaccccacttattcattgaatattcctagtaagctcatactggcctgtcgattatataacaatgacttagaccagccttcgtgtgcctttcactgaatatccacggtgatagctcgaatgccatgcattcacaagaaagtacacagcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315428 - DNA, 727 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcagcggactgtttttccatgtcatgctgctggtatctagcttgtgaatgtcattgtcgacc

SEQ ID NO: 315429 - DNA, 344 bp, Homo sapiens
cagagtggagcctccacgagtaggttgtgaccatgatatgcagattctgagctggcaatcaggtgggggtggccccacccttcactgttggagaacactgggcccaggctgctccctgacctcggcagctcccttggggcagggccagccacctgagctgagactagtgcccctgtggaggggtagtgtgggagggcccccagggtgacacttggaggcaaaggctggttctgggcagagtcacagtgagctgggcagaagcctcgcctgaggatcccgtggccccaatttgtgtgcagatagcagaggcagcaggccgtgccgggggggcatgttgctgtaac

SEQ ID NO: 315430 - DNA, 1528 bp, Homo sapiens
aagtagggccgcgagttgagtcggtcagaggatggactctgatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggacagcacacctgcccccacctcacagccaggtgtcctacagccaagcaggccccaatggccctccagtctcctcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagcctggaattc

SEQ ID NO: 315431 - DNA, 2054 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagtaagtatagttattcctgaattgctcctgccatcaaggtccctgtctttgggtggtgatatccaggactggatcctttcctcacctttgaccatctcctttccacaacttctcccttaaaggccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315432 - DNA, 2216 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggacagcacacctgcccccacctcacagccaggtgtcctacagccaagcaggccccaatggccctccagtctcctcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagcctggaattc

SEQ ID NO: 315433 - DNA, 1536 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315434 - DNA, 1411 bp, Homo sapiens
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcagttggggaggtggggaccagcagataaatcccacccttccttgagctgtcgctgtactctgaagttcagccagctcagattttataaaaattaattaaaatctcaaaa

SEQ ID NO: 315435 - DNA, 1870 bp, Homo sapiens
cgtgagctgaattcggacacgagggacggctcagcgacgccacggccataagctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315436 - DNA, 1937 bp, Homo sapiens
taccccgtacaaggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttgtacgcgtacaacgcagggtgaaccatgctgcagtggctgtcgggcatcgggtatactccttcgggggttactgctctggtgaagactatgagacactgcgtcagatagatgtgcacattttcaatgcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315437 - DNA, 1657 bp, Homo sapiens
cgtgagctgaattcggacacgagggacggctcagcgacgccacggccataagctgcaggcagctcgaggacccgcggccccgccccggctcggcctggcagtgtccttgcgttggacaaagctgcccccggtgaagtctgccatccgtgggcaagctcctgtggtaccctacatgcgctatggacactcaaccgtcctcatcgacgacacagtcctcctttggggcgggcggaatgacaccgaaggggcctgcaatgtgctctatgcctttgacgtcaatacgcacaagtggttcacaccccgagtgtcagggacagttcctggggcccgggatggacattcagcctgtgtcctaggcaagatcatgtacatttttgggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315438 - DNA, 2067 bp, Homo sapiens
  misc_feature (501)..(501): n is a, c, g, or t
  misc_feature (511)..(511): n is a, c, g, or t
  misc_feature (616)..(616): n is a, c, g, or t
ggcacttagctacgactgcacgtgcgcgcacagctgcccgccggaagaaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggatgttacggtggacagtgcacctggagggcgggccccgcagggtgaaccatgctgcagtggctgtcgggcatcgggtatactccttcgggggttactgctctggtgagagcacgtagtggaggaccacgtgcgctcacgactaggactgtgcacgagttgttcaagtgccagatgtccattgcagttcggtacagaatgcttggctcgcccgagtgaacatgctcatgtgcagtcctggtgcggtcaagagcctccagtgttgtgtgacccttgacaantgcggcctantgagacgacttcggaacacaggtccgtccaatcgacagactacaaggtctctcctttttgggggcgcaggggctggcaagtgaatgacacgatagggtgccatgncgaagtgatggcgtctatgctcttgttgtacgtactaaataacgtcacaaggtggtttcagcatcgcccgtagtagtctagggggaacatggtcctgggggacccggggactgggacattccatgccgtgtgtccctaagggcagagtagtcactgttacactttgttggaggggctacgagcagcaggcggactgtttttccaatgacattcacaagctagataccagcaccatgacatggactcttatctgtacaaagggcagccctgcacgctggagggacttccactcagccacaatgctgggaagtcacatgtatgtctttgggggccgtgccgaccgctttgggccattccattccaacaatgagatttactgcaaccgcattcgagtctttgacaccagaactgaggcttggctggactgtcccccgactccagtgctgcctgaggggcgccggagccactcggcctttggctacaatggggagctgtacatctttggtggttataatgcaaggctgaaccggcacttccatgacctctggaagtttaatcctgtgtcctttacctggaaaaagattgaaccgaaggggaaggggccatgtccccgccggcgccagtgctgctgtattgttggtgacaagattgtcctctttgggggtaccagtccatctcctgaggaaggcctgggagatgaatttgaccttatagatcattctgacttacacattttggactttagccctagtctgaagactctgtgcaaactggccgtgattcagtataacctagaccagtcctgtttgcctcatgatatcaggtgggagctgaatgccatgaccaccaacagcaatatcagtcgccccatcgtctcctcccatgggtaggaggaagtttctgccacctcccctcctgagcctgctgtcatcttcactgcccctgcccatctgtcacccacctgctcctttgacccctggacttggtatacctccatgtggagttgttgggcgagaggtgttctctgtgctgtgaattcagtggggagctgtagcggggtgggggctaggttcctccccccttgggccgagggccccttccccttggtgctctgtccccatccacctcctttcagctgctcctgggcctcagctctgcccagggccagccaggttctgctgggaagggaagggaatggggagaagggagaagcaagcagtgtctgagcctcaggagcttccccctccccctttgcctatcccctcccctctgcttgagccttgagccttgactgggagctgaaaggagttgcagctgttggcatgagacctccttctccccgtcttggggaggtggggaccagcagataaatcccacccttccttgagctgtcgctgtactctgaagttcagccagctcagattttataaaaattaattaaaatctcaaaa

SEQ ID NO: 315439 - DNA, 764 bp, Homo sapiens
atcttgaggcgtgcgaggagggggcatggcggatactgtgttgtttgagtttcttcacacggagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 315440 - DNA, 920 bp, Homo sapiens
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaacaaaaaaaaaaaaactcggcttatttcggggggggaaaagggtttggatggcctggcttgggtcggccattttgtcaagggaattgcggccaaagggatatcaacgtagggggg

SEQ ID NO: 315441 - DNA, 798 bp, Homo sapiens
atcttgaggcgtgcgaggagggggcatggcggatactgtgttgtttgagtttcttcacacggagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaaaaaaacaacacactgatacaaaacaacaaaaaag

SEQ ID NO: 315442 - DNA, 594 bp, Homo sapiens
gctcacccctgaactgacgagcaccagcaagttggtctttgggtcccctggcaggtccccccctgggtggccccgggttcgtggtggctaagggcccctgagcatctctcccctggccttctagggacagaagatgagcctgtcggtcctggagggtatggggttccgtgtgggccaggctctaggcgagaggtgagcgcggcccctcctgctctcccccagcctggctggcagggctgggcaggccccgggcggggagggttgcattgctccatgcaggagtcgggcctgtcttcctccctcttcctggcctggccccacggcctcagcttggtactgccccaccaggctgccccgggagacgctggccttcagggaggagctggatgtcctcaagttcttgtgcaaagacctgtgggtggcggtgttccagaagcagatggacagcctgcgcaccaatcaccaggtgggagcaccccggcctgcccgtccagcttcctcctgagggcaagaccaagagagtgggaggggaatcccccggcgccagagcagcggctgccgggacccgcccagagctttcccacaggcggccgc

SEQ ID NO: 315443 - DNA, 465 bp, Homo sapiens
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggtgggagcaccccggcctgcccgtccagcttcctcctgagggcaagaccaagagagtgggaggggaatcccccggcgccagagcagcggctgccgggacccgcccagagctttcccacaggcggccgc

SEQ ID NO: 315444 - DNA, 840 bp, Homo sapiens
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaaaaaaacaacacactgatacaaaacaacaaaaaag

SEQ ID NO: 315445 - DNA, 880 bp, Homo sapiens
cggaacttctccagcctaccaggagtgagccatgcatgggcagaaagcccctggtggctgcctgccctacccccagtgtgatgctgcttgtcccaagctggtctagtcccccagtgacacccaggctgtacctgcccttctgcatcttcctgggccgggtccccagcttttctgcacaaccctgggaggcgagggcaggacccacactccccagggcacaggcacccactccaagtttggaagccctgggccctaccagagcactggaggccaaggctgtgactccagtggttctcaggaagggggccttcccaacctcagcccaatctaagacctgggttcctgcttaccctccctgcgcttcaaatgtacaggccccgaccccacccaccagcctctcctctcccccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 315446 - DNA, 605 bp, Homo sapiens
atcttgaggcgtgcgaggagggggcatggcggatactgtgttgtttgagtttcttcacacggagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 315447 - DNA, 806 bp, Homo sapiens
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 315448 - DNA, 696 bp, Homo sapiens
atcttgaggcgtgcgaggagggggcatggcggatactgtgttgtttgagtttcttcacacggagatggtggctgagctgtgggctcacgaccccgaccccggcccgggggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 315449 - DNA, 724 bp, Homo sapiens
atcttgaggcgtgcgaggagggggcatggcggatactgtgttgtttgagtttcttcacacggagatggtggctgagctgtgggctcacgaccccgaccccggcccgggggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaaacagaacgaacaacgtctacaagcgcag

SEQ ID NO: 315450 - DNA, 884 bp, Homo sapiens
  misc_feature (649)..(649): n is a, c, g, or t
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaaggccttctgcagggctaggatcggagggcgggacctggggccagtggtttaactgtaccctgcctgagctaactgttgtactgggaagagcagggaaggaagcaagcagtgtcaggttcacactggggccgtcacctcctgcaggctgctgggtcaggtggtccagacggctgtggacctgcagctgtggacacacatgggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctccttgcacncgtggcactggaaacccagctccccgtgtcagaccccgctgtcttcctgagccctggggctcactgtggaggagctgacggcctggcccttggccaggtcttggctcttccctgggctcaccagggacactcttgaatgtatggcctcaggcgctccctagagggggcctaaagcccttcacttgtgaggctaaccctttaggggatccttgccccttggagatccttgccccca

SEQ ID NO: 315451 - DNA, 484 bp, Homo sapiens
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaaggtaacgcctctgggagagcggagggcgcgtcaggcgtccgggttcgaacccggcccagccccggccttgcagggcaacgtctggccctggcttcctcctttggaaagtggcgttcgcgacggtgccggctcggggttattgctaaattgagcgcgatgattcagggtaaagcacttagctcaaggcctgagtaagcggctagtaatcataataatgctgttattgggcgtgtgctgaggactcgcctcccccacttactaggtgtgcgacccaatgacttaatctttgtgtgtcctagttttctcttttgtaaaatgagtatcataacgtacc

SEQ ID NO: 315452 - DNA, 834 bp, Homo sapiens
atcttgaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaaacagaacgaacaacgtctacaagcgcag

SEQ ID NO: 315453 - DNA, 5100 bp, Homo sapiens
acccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaaaaaaaaaaaa

SEQ ID NO: 315454 - DNA, 3685 bp, Homo sapiens
tctagaggaccccgttcattttctacaccaagtagatgggcactccagtaaaaatgacatccacacactgttgaaggatcttaattcatatcttgaagataaagtctaccttacagggtataactttacattagcagatatactattgtactatggacttcatcgctttatagtgagtatttgtatagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaaaaaaaaaaaa

SEQ ID NO: 315455 - DNA, 2018 bp, Homo sapiens
tagaggacccgacgtaatatgtaaccaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaaaaaaaaaaaa

SEQ ID NO: 315456 - DNA, 3322 bp, Homo sapiens
acccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattca

SEQ ID NO: 315457 - DNA, 4808 bp, Homo sapiens
acccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggaatctaaggaaggggtcttacttctctgattcagggagtgcgaaatcccttaaactcatatcagacctgtggtcgacg

SEQ ID NO: 315458 - DNA, 5054 bp, Homo sapiens
acccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaaaaaaaaaaaa

SEQ ID NO: 315459 - DNA, 3069 bp, Homo sapiens
acccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaattttttttaaaagtcataaagccactggctttcagagacttattagaacacactcatctcttcatgcatgcttctgctagtgtcctaaatctgggctccaaattatccaaaaattcaagtcgac

SEQ ID NO: 315460 - DNA, 265 bp, Homo sapiens
cgatcctcctgcctcagcctcctgagtagctcagattacaggcgtgagccactgcgcctggcctgatcatcttctgtatattgatgtatttcctttcagcctttcattgcatttttaaatgtagtagagatagaactaaagatagaaatttgtatcttagtcttatgtttttaacctgtaattgaattataagcattttcttgtgtaacaaagagctctttggaagctgtgtctcacaagcagttatccatgtcacccaaatgtg

SEQ ID NO: 315461 - DNA, 3668 bp, Homo sapiens
attcacactggagagaaaccttatatctgcaatgagtgtggaaaatcatttggtgctcgtctatcccttatccagcatcagagaattcacactggagagaaaccttatggttgtagtgtgtgtgggaaaacctttagtcaaaagggacatcttattcagcatcagtgaattcacacaggagagaaaccctatgaatgtagtgagtgtggaaaagctttcagccagagttttaatcttattcaccatcaaagaacacacaatggtgagaagtcctatgaatgtaatgaatgtgataaagccttcagtttgctttcttcccttgttcaacatcagagaatacataatggagacaaaccctatgagtgtcacaaatgtgggaaggcctttagccaggggtcacaccttattcagcatcagaggagtcacattggtgagaaaccctatgagtgtaatgagtgtgggaaaacctttgggcagatatccaccctaattaagcatgagagaacacacaatggagagaagccctatgagtgcagtgactgtgggaaggccttcagccagagtgcacaccttatccaccatcaaagaattcacactggagagaatccctatgagtgcagtgaatgtgggaaggccttcaatgtttgttcctctctcattcagcatcacagaattcatactggtgagaaaccttatgaatgtagtgactgtggcaaggcgttcagtcagcattcacaatttatccaacatcagagaattcacactggagagaaaccctacatgtgcaatgagtgtgagaaatccttcagtgcatgcttatcccttatccaacacaagagaattcacactggagagaaaccctatgtatgtgccaaatgtggaaaatccttctgacaaagctctcaccttattcaacatcagagaattcacagtggggagcaacctcatacgtgtaatcgatgtgaaaaaaccttcagttagagaataactcttagtagtcatgagaaaatccatacaattcacattagagagcaagtctatgaatgtagtaagtgtggggaactctagcgcacagtcatctttcattcaacattgtacagttcacagtggagagtaactgattagtctataaattcttcacagttatacattatatgagagtcatactcgtgagaaatgagtcactttatggttttccttttggagattcagctcttaagggatttcactctcccagtgagctgctaactaaaggcaggctgctgaagtatatagcagcaatcccacaatagcacaccttgcttcagattcagaggatgagcccccttcttgagccctgtagatatgtgaaacttaattatttagatgcatttcatggcaccagaccctaaggtacagttaggtatttcactggagaccacttactttgctttgctttgctttttttttttttttttgtatgatttatttcaacttcaaagaaagtagttgagatccttgcacttccaagtgtgatggaaccaggctagggttttctttgtttgtttgggcctcttcaaaacgtttttattctgttataaggaatatgataccttaagcttcaattcacagggaagagaaacatgattataagcaaaagtttgtcaaggaataaggtgagtctttgtgtagattaaaatagttgagaccttgctaaaaagtcagataacactgtaatccacctccaggtttccaagagttaagacgctgccagcaaggagcttgcagtcttgtagctggcccaatatatccaactaattcaaaatgggaaattgtacattttacttaaacaggatttggtagatgggtcttctagatatgttgtcatgaagaaaaatcaggtagctatgttacactgcaagaacagagttcatggcttttcctgaggtggctggaaaccttaatctcctgaagttaagtcaaaacttaaatgtcaattcacccagctctcttgcctgcaggctgatccagggacttagagcttgttacccagttacaacttcttctagagaagaacttttaagaaggaagcaaaaagaaattcagtttcccccaaggatctcttctttgaggttccatcaagagatgacaaaaggaggctgggtgcggtgtctcacacctgtaatcccagcactttgggaggctgaagtgggcagatcacgaggtcaagagatcaagaccatcctggccaacatggtgaaaccacatttctacaaaatgcaaaaattagctgggcatggtggtgcacgcctgtagtcccagctacttgggaggctgaggcaggagaattgcttgaacccaggaggcggaggtagcagtgagccaagattgcaccactgcattccagcatggccacaaagcaagactccaaaaaatatatatatatatgacaaaagggttaggaagcttttcctctgaggcccacgattacacaaccaaatcagaaaataatattttttttgttttaaacctgtttacataagatggaggtgtttacttaactaagaacctcggtatttactcaaatccggttttgggttttatggctaaaacatttctccagattaaccttatcagtttggaatatgtttttattttccattaaatatttcatccaaatcatactgaattttatttatcatgggcttttaatgttctctattcaagtcaaatttctgtttcctaattacttgggcttggtgatggcattaatattggttgggagctagatggtctctgctctatttgatgattggcatagagcaatcatacacttggtacttcctagcatttttttttgagacagtatcatgctgtatcatgttgcacagggtggagtgcagtggtgcagtcatagctcactgtaaccttgaactcctgggctcaagtgattcccctgcctcaacttcatgagtagcagggactacagctgtgtaccaccacaccggcctctcctggcttcttaaccacttacattaaaattgagaggagaaaggcattttcagtttctttagttaataaaaagaagccatttctggaggagttttatgcctgtaccagcagaggttcagccttccaggaatctcatcatgatccatactgctgacacaggcctttgtcacctgaagcattcttaaaataaggagactgacattaaacaggacaattgtgaactccactttgtaagcatcatacatatcttacaactcattctgaagactcctttattcttgctcttcccagagagctactgtgtttagtcatgctcactgcactcacaagagaaaaagagtaagtggcatatttgcaggtgttgatggttacaagagcatttttactttttcctccatgtttgttctgcagcatttccattgatgcatgctattgtagacttcttaggttgaccttggccttgacctccaccactagctcatgacccaaaactgaagatgtgcatcagaaagggacagatttggtctttctgctgtaaaagatattctgccttagtgcctgctaatttgttgtgcatagtcctgtgctgccaatcttccccaccaattgttaaggttaatgtgtgttttatatgtgtattcacaaacattaaaatgtaatcagtggattccaaaatt

SEQ ID NO: 315462 - DNA, 3722 bp, Homo sapiens
attcacactggagagaaaccttatatctgcaatgagtgtggaaaatcatttggtgctcgtctatcccttatccagcatcagagaattcacactggagagaaaccttatggttgtagtgtgtgtgggaaaacctttagtcaaaagggacatcttattcagcatcagtgaattcacacaggagagaaaccctatgaatgtagtgagtgtggaaaagctttcagccagagttttaatcttattcaccatcaaagaacacacaatggtgagaagtcctatgaatgtaatgaatgtgataaagccttcagtttgctttcttcccttgttcaacatcagagaatacataatggagacaaaccctatgagtgtcacaaatgtgggaaggcctttagccaggggtcacaccttattcagcatcagaggagtcacattggtgagaaaccctatgagtgtaatgagtgtgggaaaacctttgggcagatatccaccctaattaagcatgagagaacacacaatggagagaagccctatgagtgcagtgactgtgggaaggccttcagccagagtgcacaccttatccaccatcaaagaattcacactggagagaatccctatgagtgcagtgaatgtgggaaggccttcaatgtttgttcctctctcattcagcatcacagaattcatactggtgagaaaccttatgaatgtagtgactgtggcaaggcgttcagtcagcattcacaatttatccaacatcagagaattcacactggagagaaaccctacatgtgcaatgagtgtgagaaatccttcagtgcatgcttatcccttatccaacacaagagaattcacactggagagaaaccctatgtatgtgccaaatgtggaaaatccttctgacaaagctctcaccttattcaacatcagagaattcacagtggggagcaacctcatacgtgtaatcgatgtgaaaaaaccttcagttagagaataactcttagtagtcatgagaaaatccatacaattcacattagagagcaagtctatgaatgtagtaagtgtggggaactctagcgcacagtcatctttcattcaacattgtacagttcacagtggagagtaactgattagtctataaattcttcacagttatacattatatgagagtcatactcgtgagaaatgagtcactttatggttttccttttggagattcagctcttaagggatttcactctcccagtgagctgctaactaaaggcaggctgctgaagtatatagcagcaatcccacaatagcacaccttgcttcagattcagaggatgagcccccttcttgagccctgtagatatgtgaaacttaattatttagatgcatttcatggcaccagaccctaaggtacagttaggtatttcactggagaccacttactttgctttgctttgctttttttttttttttttgtatgatttatttcaacttcaaagaaagtagttgagatccttgcacttccaagtgtgatggaaccaggctagggttttctttgtttgtttgggcctcttcaaaacgtttttattctgttataaggaatatgataccttaagcttcaattcacagggaagagaaacatgattataagcaaaagtttgtcaaggaataaggtgagtctttgtgtagattaaaatagttgagaccttgctaaaaagtcagataacactgtaatccacctccaggtttccaagagttaagacgctgccagcaaggagcttgcagtcttgtagctggcccaatatatccaactaattcaaaatgggaaattgtacattttacttaaacaggatttggtagatgggtcttctagatatgttgtcatgaagaaaaatcaggaaaatgtccaagggtgggagcctgtggcttatggcttcacttacccatcacagatagctatgttacactgcaagaacagagttcatggcttttcctgaggtggctggaaaccttaatctcctgaagttaagtcaaaacttaaatgtcaattcacccagctctcttgcctgcaggctgatccagggacttagagcttgttacccagttacaacttcttctagagaagaacttttaagaaggaagcaaaaagaaattcagtttcccccaaggatctcttctttgaggttccatcaagagatgacaaaaggaggctgggtgcggtgtctcacacctgtaatcccagcactttgggaggctgaagtgggcagatcacgaggtcaagagatcaagaccatcctggccaacatggtgaaaccacatttctacaaaatgcaaaaattagctgggcatggtggtgcacgcctgtagtcccagctacttgggaggctgaggcaggagaattgcttgaacccaggaggcggaggtagcagtgagccaagattgcaccactgcattccagcatggccacaaagcaagactccaaaaaatatatatatatatgacaaaagggttaggaagcttttcctctgaggcccacgattacacaaccaaatcagaaaataatattttttttgttttaaacctgtttacataagatggaggtgtttacttaactaagaacctcggtatttactcaaatccggttttgggttttatggctaaaacatttctccagattaaccttatcagtttggaatatgtttttattttccattaaatatttcatccaaatcatactgaattttatttatcatgggcttttaatgttctctattcaagtcaaatttctgtttcctaattacttgggcttggtgatggcattaatattggttgggagctagatggtctctgctctatttgatgattggcatagagcaatcatacacttggtacttcctagcatttttttttgagacagtatcatgctgtatcatgttgcacagggtggagtgcagtggtgcagtcatagctcactgtaaccttgaactcctgggctcaagtgattcccctgcctcaacttcatgagtagcagggactacagctgtgtaccaccacaccggcctctcctggcttcttaaccacttacattaaaattgagaggagaaaggcattttcagtttctttagttaataaaaagaagccatttctggaggagttttatgcctgtaccagcagaggttcagccttccaggaatctcatcatgatccatactgctgacacaggcctttgtcacctgaagcattcttaaaataaggagactgacattaaacaggacaattgtgaactccactttgtaagcatcatacatatcttacaactcattctgaagactcctttattcttgctcttcccagagagctactgtgtttagtcatgctcactgcactcacaagagaaaaagagtaagtggcatatttgcaggtgttgatggttacaagagcatttttactttttcctccatgtttgttctgcagcatttccattgatgcatgctattgtagacttcttaggttgaccttggccttgacctccaccactagctcatgacccaaaactgaagatgtgcatcagaaagggacagatttggtctttctgctgtaaaagatattctgccttagtgcctgctaatttgttgtgcatagtcctgtgctgccaatcttccccaccaattgttaaggttaatgtgtgttttatatgtgtattcacaaacattaaaatgtaatcagtggattccaaaatt

SEQ ID NO: 315463 - DNA, 629 bp, Homo sapiens
tcctggcctcaaatgatcctctctcctgagtctctcaaaatgctgggattacaggcatgagccaccctgccgcagtgtttcttctttttgtcaaagcacttaagatctttttgtcatgaagttagtcacagtagggttactttttgtttcatagttaatgaccaaaaatttcaggaggaaaaattactaagacctcttaagtatcttttaaaaatatgttgaatgcttgaaagcttttttcaggcaaagagctcctttctatctgagccataagaatatgctaaaaacagttcataaggatggaatcttcagttcccatgtgtgacattctcaggtgcatacttgcagtgtggccatgtcagctatgtggcagagacctagattcactagtagtgtgacaggctaactgtaagctggttgtctgcttgcctccagtgtgttcattctgtgaatgaaatgtgtatttcttttgttatctaaaatgttctttctccccgtttctagctctcgtgctcattcccccatgatcgccgtaggaagtgatgacagtagccccaacgcaatggccaaggttcagatttttgaatataatgaaaacaccagtatatgtgagctgaggaccatccttg

SEQ ID NO: 315464 - DNA, 3243 bp, Homo sapiens
tggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtatatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctcttgggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatacacaggaatgatttagtttacatactagtcagttacaacattagcctgtaaaatgaaatccattttttaaggtctcataaggcagaataaacttcataatattatgctttcacattagccagtctga

SEQ ID NO: 315465 - DNA, 1395 bp, Homo sapiens
tggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagat

SEQ ID NO: 315466 - DNA, 491 bp, Homo sapiens
caaaacaatttcaggttaccgtggaagataccagattataaagattatttcatgaaacaaataatattagagttgattttttaaagtctggtttttggtcactgcctgtactgcatattttcttttgtaaatagcttctattttttgatctgtattcttattgtgccaataaccatctgtgttagatctgtgatgcattttcccttttccatttgtattatgtcctttaacagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgaga

SEQ ID NO: 315467 - DNA, 3336 bp, Homo sapiens
tggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtatatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctcttgggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaatgtggactttttggtcttttttttttttttttttttttaaaggaaattgcctttcactacttggaattactgtttaaagcttttgtaattattatccaagtaggttatgtaataaaatatattta

SEQ ID NO: 315468 - DNA, 3202 bp, Homo sapiens
tggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtatatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctcttgggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagc

SEQ ID NO: 315469 - DNA, 3282 bp, Homo sapiens
tggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtatatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctcttgggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggattttttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaatgtggactttttggtcttttttttttttttttttttttaaaggaaattgcctttcactacttggaattactgtttaaagcttttgtaattattatccaagtaggttatgtaataaaatatattta

SEQ ID NO: 315470 - DNA, 1714 bp, Homo sapiens
tggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaatgtggactttttggtcttttttttttttttttttttttaaaggaaattgcctttcactacttggaattactgtttaaagcttttgtaattattatccaagtaggttatgtaataaaatatattta

SEQ ID NO: 315471 - DNA, 1274 bp, Homo sapiens
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315472 - DNA, 988 bp, Homo sapiens
cagcaggagccgcggcggggaggggcgtcttgggcctggagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315473 - DNA, 1181 bp, Homo sapiens
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaaggaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315474 - DNA, 1084 bp, Homo sapiens
cagcaggagccgcggcggggaggggcgtcttgggcctggaggtcagtgtggcctcgcgtttgtcttcggtgacgggaagtgagtttcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaaggaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315475 - DNA, 930 bp, Homo sapiens
cacttcatgtctattttcttctagcaattgaatctttccagcatcaagattttttatttactgttgaaacgtgcatcaaacactactggcaatagtataaagccctttttaaaaaaagtttttatagcatctaggatctgtgcagtatcttaaattgtgtaattatttttgtagtatgcacagaatagtattgtctctacattcagtttgtggattgtgattgtcctctttgtggaaattcaaacagaaaagcaatgatcaaagaaacaaagagcttaattggctttccatgtgtggtaatttgtatgtctttatgcagtttgtgagttccaaatcttttcagattgaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315476 - DNA, 962 bp, Homo sapiens
cagcaggagccgcggcggggaggggcgtcttgggcctggaggtcagtgtggcctcgcgtttgtcttcggtgacgggaaattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315477 - DNA, 1224 bp, Homo sapiens
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagtcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315478 - DNA, 382 bp, Homo sapiens
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaagggcatcagagaggctgagaaggtgagaacttaggcacaaaagaggcagttagatcggcacccccttagccagagagattagagaggga

SEQ ID NO: 315479 - DNA, 1321 bp, Homo sapiens
  misc_feature (1282)..(1282): n is a, c, g, or t
  misc_feature (1293)..(1293): n is a, c, g, or t
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagcacggcaggcgtgcccggcccatccctncccctctccanacacctcccctctccaccgcctctcaca

SEQ ID NO: 315480 - DNA, 1177 bp, Homo sapiens
cagcaggagccgcggcggggaggggcgtcttgggcctggaggtcagtgtggcctcgcgtttgtcttcggtgacgggaagtgagtttcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315481 - DNA, 1291 bp, Homo sapiens
  misc_feature (1252)..(1252): n is a, c, g, or t
  misc_feature (1263)..(1263): n is a, c, g, or t
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcaataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagcacggcaggcgtgcccggcccatccctncccctctccanacacctcccctctccaccgcctctcaca

SEQ ID NO: 315482 - DNA, 1111 bp, Homo sapiens
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaataaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaataaaaaa

SEQ ID NO: 315483 - DNA, 979 bp, Homo sapiens
ggaaagggtccagtggctgcttttatcgaccaatcaaatattttcctgacagatcccaaaatattcctgggccaacggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcgattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggattttgactctttcttctctgcaaaagaagagaatattatttattccttccttggtttggctcctcctccagactcaaagggatcagagaaggctgaagaaggtggagaaactgaggcacaaaaagagggcagtgaagatgtgggcaacctccctgaagcccaggagaagaatgaagaagaaggagagacagccacagaagagacggaagaaatagccatggagggtgcggaaggggaagccgaggaggaggaagaaactgcagaaggagaagaagagcctggagaagacgaagattcctaggccttttcatgcttcatttcttccacttctccagggtagctacaggattctggggtggaaaagctgctagttaccgtactgtatgctatctgcggcacattttgcttagtaacaggagaaagggaattccaattcagggctgtctgtctccttccaaagccct

SEQ ID NO: 315484 - DNA, 644 bp, Homo sapiens
gaatgccagccttaagagtgtggggtcacagaagtccacagtgtttcaatgcagggacccgctgaatgcagctgagcatttatttacattttccaagatgagagctgacatatcttttattgtatttagcaagagcagctttgttgaggtggtagaagtgtaactagattggagtgggtcgaagatgaatgatgaatgggagaggacaaaatggaaacaagaatgtatgattttccagaagtttggctgtgaaggagtagagggtgatactggagggagtgatatagggtcaagggaagactttttacattttttattttttaaggtggaaaagtctagatcctgacccacttagggttgtacctgatgaaaccgggatcatttacttacacagctagtgtattaggaaactgttcttggtgaggattgaatgaaagaatgcatatcagcactccatacatggaaagcacttaaatgttggctctgttggcagaatcaggctgagtggtccagagcccccatggatctggtcctgttccaagctctttagtaaggctgctctcctgcaacccctcctcattttttggtcaggtagaatcgggaaagtccacactgtctcctaatacttaaatcccaagcttctt

SEQ ID NO: 315485 - DNA, 1137 bp, Homo sapiens
ggacgcgtgggtccggacgcgtgggcccaactaggcgcaatttacattgacgcgtcatgccttacgtgggaaggacaacagttccaggggaaagctgccattgtggagaagttgtctagccttccgttccagaaaattcagcacagcatcaccgcccagacattgatttgttcagatgtttcaatgcctcatgatacaataaaaccacaaaaattttcttaacagttaaaaaacaaaaaaaaaaaaaaaaaaaaaaaacaaaaaaaaaaaaaaaaacaaacaaaaaaaacaccaaaccacacaaaaacaaaaaagaacacaaaaaacacaaaacagaaccaaaaaacaacaacaagaacaacaaaaccagcacaacacactaaaaaacacgcacacaacaaaaaaacaactagaacgcgtggggcgggaaggtaaatatagcgagtaccgatagtgaaccggggtaacggctcgcgcgcatacgaactaataaggacgggcacaagaagccactcgaatacggcagtacaacaagatgcgaacagccaacgactggggagcggcgcaaacactaagagcacgcaggaaggctaagaagtacctacgacaatagagtcaaacagctagcagcaacgaccagaacgcgtctggaggtcaaagacgcgaggcgccgttccaccacacagcgcaagatcaatgacggtccggcacgagacaataaaacaacgcaagcagtgaagagcgagtcagatccagacgcgacgcagcatcagtaccgcgcgaaggagaaaagagaaagacggacagactataagtagactaactactaaatggagggacgacgctacatcaacaccacggaccccagcatcatgacaaacccagagcggaccccaacggagccgacgcgagcagaccgtcacgagcccagcgacggacgcggagccgaaagcaccgcccaaggccgacgcaccgccaactgcgaccacgacccagacacgccagccagaggacacacgcgcagagcaacacacgaccgagactccaccacaccccagactgagtcgaccgcaccgcaacgaacgaccgcaccggacaggccgaccgaccgagaaacccgacggccctgcagacgac

SEQ ID NO: 315486 - DNA, 2146 bp, Homo sapiens
ggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaattgttttaattagtttactagttggctgggcatcagaagctacccagacccgttgtctctctcatgtttcaccctcccacttctgccccaactctgaatacctgttgcagggagaaactgctgaagcagcactcccagctagcctctcagaagccgtgtagggcagttctctcccactccacagggcgactggtctttggaaagcaggcaggaagagctcaggtctggcctgaagcttctctcactgaagcctgtgcagtcagttctgatacctcctgtgacttctgctctgggtaggttcagggccctagtagcaggagagatgatcctgaatcctgttgaagctggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggatacccttcccctgtcccactacgggtggaggctaaggacctcctcagatcccacagattgcctggtgacattgggcacagggctggatggtgtgctgtttgagaggacagcatgctcaggagatttcagtgggaatgatctctaggctgatgtgtatttggggaagtgggggtggggaagaggtaggtgcctgctgcctcaaaccaccttgtgtaaaatctgcaatacggcttcttccatgtacctgtgcctgaactgtctgcaataaagaagaatttgta

SEQ ID NO: 315487 - DNA, 894 bp, Homo sapiens
ggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgtccccgtacatcgttagaagcttgaatt

SEQ ID NO: 315488 - DNA, 887 bp, Homo sapiens
  misc_feature (41)..(41): n is a, c, g, or t
cgaggggaccaaccttaggctaggtacgaggctgggtgtgngctgcgctgcgcatcgtgcagccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315489 - DNA, 878 bp, Homo sapiens
gctggtacaggtcccgagttcgttgggattgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315490 - DNA, 879 bp, Homo sapiens
tcttgtctccaggcccacgttgtcactagaagtcctgactctggagaggcctccaaatctggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315491 - DNA, 2148 bp, Homo sapiens
gaagggctggcctctcagcccaggctctgacacactcatgcacttagtcaacaaatagtttgtttgagggctgggccaggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaattgttttaattagtttactagttggctgggcatcagaagctacccagacccgttgtctctctcatgtttcaccctcccacttctgccccaactctgaatacctgttgcagggagaaactgctgaagcagcactcccagctagcctctcagaagccgtgtagggcagttctctcccactccacagggcgactggtctttggaaagcaggcaggaagagctcaggtctggcctgaagcttctctcactgaagcctgtgcagtcagttctgatacctcctgtgacttctgctctgggtaggttcagggccctagtagcaggagagatgatcctgaatcctgttgaagctggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggatacccttcccctgtcccactacgggtggaggctaaggacctcctcagatcccacagattgcctggtgacattgggcacagggctggatggtgtgctgtttgagaggacagcatgctcaggagatttcagtgggaatgatctctaggctgatgtgtatttggggaagtgggggtggggaagaggtaggtgcctgctgcctcaaaccaccttgtgtaaaatctgcaatacggcttcttccatgtacctgtgcctgaactgtctgcaataaagaagaatttgtaactgtggtttctttcttccaacctgagggtgccaggtg

SEQ ID NO: 315492 - DNA, 2186 bp, Homo sapiens
cagtttttttgatactctataagttacttggtaaatactatgggattcgtttcaaaattgtgatcacttgtgtctggagatatgtgcttggaggcaggtacatcctctgctcttttgctgtagctaagggtgaattattgtgcagtttaagcacacatagcacacataggcgtggctgattgttggcctacatgtgcccagggcattgtttcatacattacatcaattcacattcacaagtaccccttggctacactgggatttgagttcaggacagtagggcctgatcctaaagtcaacatttttttgccctcttctcctaccactgaattcccttcctgtttcttgatccccttactgaatcctcttttctctcctcataggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaattgttttaattagtttactagttggctgggcatcagaagctacccagacccgttgtctctctcatgtttcaccctcccacttctgccccaactctgaatacctgttgcagggagaaactgctgaagcagcactcccagctagcctctcagaagccgtgtagggcagttctctcccactccacagggcgactggtctttggaaagcaggcaggaagagctcaggtctggcctgaagcttctctcactgaagcctgtgcagtcagttctgatacctcctgtgacttctgctctgggtaggttcagggccctagtagcaggagagatgatcctgaatcctgttgaagctggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggatacccttcccctgtcccactacgggtggaggctaaggacctcctcagatcccacagattgcctggtgacattgggcacagggctggatggtgtgctgtttgagaggacagcatgctcaggagatttcagtgggaatgatctctaggctgatgtgtatttggggaagtgggggtggggaagaggtaggtgcctgctgcctcaaaccaccttgtgtaaaatctgcaatacggcttcttccatgtacctgtgcctgaactgtctgcaataaagaagaatttgtaactgtggtttctttcttccaacctgagggtgccaggtg

SEQ ID NO: 315493 - DNA, 671 bp, Homo sapiens
ggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctccactcccgggagtggagagagaatgcccagtgaccagtcactgaccctgtgcagaacctcctggaagcgagctttgctgggagagggggtagctagcctgagagggaacctctagggacctcaaagggattgtgc

SEQ ID NO: 315494 - DNA, 784 bp, Homo sapiens
ggaaggcaggggggaagggacagtcggccgcagaccgcgctgggttgccgctgccgctgccgccatcgtgccagcccctcgggtgagtgtcggggccagcacgccggggcgggggctgggccgcaggagccgctctctgggctgccgggaggctccgctgagagtccccgggcggcccctcccctcccccccccccggcggcccgaagccgcgcggggcccgggccatgtgtcgcgcgcggctccgcctcccgccggtcctgtgaggcggcggccgggggtaacgcacagagagccagccgggcgcctatctgggccgtaccgtgctggtggctggtgcaccggcctgcgccatggccaggcctttttctctagtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtaagggcgcccgcctgccgcagccggggcttgggcccctcaccctgttcccgaccatagcccggccggggtgtaggtgaacgccccctccttgtctgcccctcggaagtgtacgtttcttaccgcgccctttgtggagcccggactggagttctcgcagggagggcagggtcagggaatatgaggcgggaggggattccacgggagactttatccctgtcttgtcttaga

SEQ ID NO: 315495 - DNA, 900 bp, Homo sapiens
ggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315496 - DNA, 2184 bp, Homo sapiens
ggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtttaaattgttttaattagtttactagttggctgggcatcagaagctacccagacccgttgtctctctcatgtttcaccctcccacttctgccccaactctgaatacctgttgcagggagaaactgctgaagcagcactcccagctagcctctcagaagccgtgtagggcagttctctcccactccacagggcgactggtctttggaaagcaggcaggaagagctcaggtctggcctgaagcttctctcactgaagcctgtgcagtcagttctgatacctcctgtgacttctgctctgggtaggttcagggccctagtagcaggagagatgatcctgaatcctgttgaagctggagaggccttggcaaaatggctcatcacgttcaggccctccgggctgagttgtcagcagtatcaagggaggggcctgctctatccccagaaggatcaggatcatatccaggatgccccacatacaccaagccaggcagagggcagctcagctcctgtcccatctgctttggatatctttacccaaaggcaggtaacccgaagagccagcctccactgcccacagagccaggcccagttgtgttggagtataggtcaggagctgtggaaggaggcagtctgtgagggactcatgctttaggagtcctcacccctcagactgctgcaggacattgccaggcctctctccacttccttcctcagcatacagacttcatgctatcttccaattccggggagtcttagctattagggcagtttctgcttctccattttggggacaaaggccttgcccagtacaaatctagccccttgtcccacagacttctggatggtataaacctagtggcaatgtagcaaccataggctagaaccaaacccaagatttgggtcagtgccctgttaagggttttaggattggtaaggacaccacagctaaatctgacatgtaaaaggatacccttcccctgtcccactacgggtggaggctaaggacctcctcagatcccacagattgcctggtgacattgggcacagggctggatggtgtgctgtttgagaggacagcatgctcaggagatttcagtgggaatgatctctaggctgatgtgtatttggggaagtgggggtggggaagaggtaggtgcctgctgcctcaaaccaccttgtgtaaaatctgcaatacggcttcttccatgtacctgtgcctgaactgtctgcaataaagaagaatttgtaactgtggtttctttcttccaacctgagggtgccaggtg

SEQ ID NO: 315497 - DNA, 938 bp, Homo sapiens
ggaaggcaggggggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagttcaaaacaagaaacaaataacaaataaacaagaggggcg

SEQ ID NO: 315498 - DNA, 1371 bp, Homo sapiens
ggaaggcaggggggaagggacagtcggccgcagaccgcgctgggttgccgctgccgctgccgccatcgtgccagcccctcgggtgagtgtcggggccagcacgccggggcgggggctgggccgcaggagccgctctctgggctgccgggaggctccgctgagagtccccgggcggcccctcccctcccccccccccggcggcccgaagccgcgcggggcccgggccatgtgtcgcgcgcggctccgcctcccgccggtcctgtgaggcggcggccgggggtaacgcacagagagccagccgggcgcctatctgggccgtaccgtgctggtggctggtgcaccggcctgcgccatggccaggcctttttctctagtcaggaccgtccggatggggccttagggccccgccccgtctagcctggcccggcctgcgcgagccccgcaagctctgcaggctggctagcgggcagaccccagccccacgtcctgctacccacctacgaaggatccggggatgggcagcgccacccggcccgctccagagtcagcatgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315499 - DNA, 890 bp, Homo sapiens
taggtcagtagcgaggcggtgtgaattcggcaccgagggccgtgcgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315500 - DNA, 786 bp, Homo sapiens
cgagctcggtaccccactatggtgattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagtt

SEQ ID NO: 315501 - DNA, 916 bp, Homo sapiens
gctggtacaggtcccgagttcgttgggattgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccattgtggagaagttgtctagccttccgttccagaaaattcagcacagcatcaccgcgcaggaccatcagcccactccagatagctgcatcatcagcatggttgtgggccagcttaaggcggatgaagaccccatcatggggttccaccagatgttcctattaaagaacatcaacgatgcttgggtttgcaccaatgacatgttcaggctcgccctgcacaactttggctgacctcctctcagctaggcactcacgctgtttcctcctccctcctcttcccaatactattcccactcctccagatgctccaaatatcatgcacaaatgagcagggccgcggtgggagtgggcgcagtgcgctgctgccactgaggtgttgtgcatgatgtttggatgctagactagttgcatctgacgggagaagtttgtgttgtaccagcgcatgccttggaaagacttaagtaatgcaaaaggttgtcctttttttttttttttttttttaatctactgacaagttgctctagtaacccaaagaagtgaaggagaaagcagctgcctcaccgcccagacattgatttgttcagatgtttcaatgcctcatgatacaataaaaccacaaaaattttcttaacagttcaaaacaagaaacaaataacaaataaacaagaggggcg

SEQ ID NO: 315502 - DNA, 754 bp, Homo sapiens
ttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagc

SEQ ID NO: 315503 - DNA, 3323 bp, Homo sapiens
gcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315504 - DNA, 1914 bp, Homo sapiens
gcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagc

SEQ ID NO: 315505 - DNA, 3379 bp, Homo sapiens
  misc_feature (6)..(6): n is a, c, g, or t
aagcanaacctgtggcttaagactgggtgaaactcgcttggaagctggacactggcggacccggcctgctccctggtaagaaggttgcattgactgtggcccggtgcccgaagagggcttctccttgttcttggatagggtgcacattcgcgtggcctccgtttaagctgccaactagatcctctccttttttcgtgttttctttggagaagtccaaggaggtatccaaggaggaggatagagatgttatctttctctcggtctctcccatggaggggacggtggtcacaggctcgtgccgaattcggcacgagctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315506 - DNA, 1356 bp, Homo sapiens
gcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccga

SEQ ID NO: 315507 - DNA, 3478 bp, Homo sapiens
  misc_feature (6)..(6): n is a, c, g, or t
aagcanaacctgtggcttaagactgggtgaaactcgcttggaagctggacactggcggacccggcctgctccctggtaagaaggttgcattgactgtggcccggtgcccgaagagggcttctccttgttcttggatagggtgcacattcgcgtggcctccgtttaagctgccaactagatcctctccttttttcgtgttttctttggagaagtccaaggaggtatccaaggaggaggatagagatgttatctttctctcggtctctcccatggaggggacggtggtcacaggctcgtgccgaattcggcacgagctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagaccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtccccctgtggggtgcctcctgggtggtcgcccgcaggccgccctccgcctgtgcctaggccagagccaggcactgacaccagcagggacgggcctgggggggacacccagtgccacagctccacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315508 - DNA, 2842 bp, Homo sapiens
gccagggagctgctggtgccctggaaacacagctgaagttccagccacgtccacagaagtctctcccctccgcggatcagtcatttccataaaaagtagatgctatcagaacatcttttctctcatggtttcatgccaagcccagagaaacctccagcgaaaacgtgtctcgggggctgcttcctgtgcctggcacaggcgcagggggttgagggtgacactgggggctggtcagtgacagaggcagcctcaggctgaggacagatcctagaagaggcgtttgatctcaggccaagattcagagtgcggcgaatatggaagtattaaagatcagccaaggggccgccagcttagccctgggagtagatttgggattttgttccaagagaatcacccactttgctgattaatcctgttttcattgggtcatctggatagagtgttgttcccaggagtgggaagcgtgtgatctgggccagtaagtgggtggcacctgcctccccacttggacctgggttcttggcctctgccattgctggctggcggcagggcacctgggcgccagggtgtgtgggcagcagctctgtgtggcgtggtgcccaccctgggtggcatcacgcaggcgtgtcggcctctcattgcagacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315509 - DNA, 2163 bp, Homo sapiens
ttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315510 - DNA, 1301 bp, Homo sapiens
aggaacagccgcggcggcccggctcgcgcgctgcttgcctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315511 - DNA, 1342 bp, Homo sapiens
cggctctcagcgcccccacctgcgcgcacggccagagttgggtccccgcgtggtggtggcggcgatccggcgggccgggcatgggcgtagcccggggaccgaggcgcgggcgggggatggggtcgggcacgttaagggaggcggcggcggcggcggcaggagggggcgaagcggaggaggcgcgggagggagggcgcagcctcatccccggcgcccggggcgggtcccctcctccgcagggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315512 - DNA, 1006 bp, Homo sapiens
  misc_feature (6)..(6): n is a, c, g, or t
aagcanaacctgtggcttaagactgggtgaaactcgcttggaagctggacactggcggacccggcctgctccctggtaagaaggttgcattgactgtggcccggtgcccgaagagggcttctccttgttcttggatagggtgcacattcgcgtggcctccgtttaagctgccaactagatcctctccttttttcgtgttttctttggagaagtccaaggaggtatccaaggaggaggatagagatgttatctttctctcggtctctcccatggaggggacggtggtcacaggctcgtgccgaattcggcacgagctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagttatgactccctaaagcccatgtcgaagcccccatcgctgggtcaatagtacttgccgcagtacttttaaaactaggcggctata

SEQ ID NO: 315513 - DNA, 3614 bp, Homo sapiens
  misc_feature (6)..(6): n is a, c, g, or t
aagcanaacctgtggcttaagactgggtgaaactcgcttggaagctggacactggcggacccggcctgctccctggtaagaaggttgcattgactgtggcccggtgcccgaagagggcttctccttgttcttggatagggtgcacattcgcgtggcctccgtttaagctgccaactagatcctctccttttttcgtgttttctttggagaagtccaaggaggtatccaaggaggaggatagagatgttatctttctctcggtctctcccatggaggggacggtggtcacaggctcgtgccgaattcggcacgagctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315514 - DNA, 2755 bp, Homo sapiens
gcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtgatccagggaccggtccgggcgaggcggcggcgttgtggtgggtgactgagcctcaggattgagcaccgagagctctccacggagggcatcatgatggtgaagctaggctaccatatgcgctgtgtaacacagattctcctctgccgctatgtggacattggcatcccatgcaaccaacaagggagctcactcagtggcgtttaatgtggtggatgcgtggctcgggaa

SEQ ID NO: 315515 - DNA, 1312 bp, Homo sapiens
gcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggtgggtgccacacccccaggacccctcccaggcggcaggtcctggctccaccacctcccccgccgcagccggcaccctgggtgctgccagggaactctgctgccgaggctgttttctgaggaggctggttgcacacgggctcctgcccggctgcagctgccccatgagctgtgcccgaagcccttcctgggccttaccggcacctccggtacctccaggtctgtttccctcactcctc

SEQ ID NO: 315516 - DNA, 3136 bp, Homo sapiens
gcagcccccaggatgcaggaggagcctggacaccttcggcccagtcgggccaggcctctggaaggcccttcatgggactctccatccttggccccgccggcctccgcccaacgtcctcttcctcctccagtttcccgtatccttcccgccacttcgggcagggctgggaggtggtgcggatgggcgccatgccccaaaacagcagcctgagcaccgcagtgccttccgggatgggtgatgggtgccaagtgttctggccacccgccccctgccgctcacagctttcaccaccagcatccggctccttcccgctcttctccccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtccccctgtggggtgcctcctgggtggtcgcccgcaggccgccctccgcctgtgcctaggccagagccaggcactgacaccagcagggacgggcctgggggggacacccagtgccacagctccacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcgggggccaggactgcgctcaggatcccgccccggagcccccagcccgggggagagggggagggagttgggagaagcccagcccctcgccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtt

SEQ ID NO: 315517 - DNA, 547 bp, Homo sapiens
cgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttaatagtttttttttttttggttttgtttttatcttgttttcttggggttgccccctcttgtttgtgttgtgtgtggaaatggcgaactcggcaaatacaaacaccgtggtaaggacgtggttcggtggccggcgggggcttcgttcaggctgcagcaacggccggaccgggcgggggcggggacggcggcgactcccggcctcgactcttcagccgcccg

SEQ ID NO: 315518 - DNA, 3701 bp, Homo sapiens
cgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttaatagtttttttttttttggttttgtttttatcttgttttcttggggttgccccctcttgtttgtgttgtgtgtggaaatggcgaactcggcaaatacaaacaccgtgcctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctatgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttattta

SEQ ID NO: 315519 - DNA, 4546 bp, Homo sapiens
tggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaatttttttttctacttcccacccagcttaccaccttgatctctttaacttatgttctaaactttggtgttaatggtggtgtctagcatgctagtagttagattttatttagatgccataactggtaatacagcttttattttgactatattaatttagtttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 315520 - DNA, 3853 bp, Homo sapiens
tggggttttgtgtaggaaaaccataattgttgattttaaatacaggtacctgccaccggtaattagcatgtaaagctttgtctatattccttcctccaacttgggttcaatcagaagatacttgttggaatgaactgaagaaacttcccttttgatagattgaactgaaactgcttattgtatgtggttatatttggtaaaagttgcgtgtgagctttttacaaaagggtaagaattgtgttgaattttaattcacttgtataagaaaacaatttaaaactctcataataggtcttaaatatttttacttgctattctccctcagtgatatatacctcttcctttccagctttatgaaacatctatttaagatttaaagttatcagtgatcatagtttggagataaaatttgacccaggaatgaatatttattttaattaggttttcatacttattaaatgtaattaaagacttgggtcttgtctgagttcagtggaattgaaaccacaactttaatttccttacagaaaaacttaatttgtttcttttagtgccacaccttaaaaagaaaccccaaactagctcctcaggaatatagttttattttgcaagcataccatctagctgaaattgtatacacatgaatatatgtagacttttcctgttgggctgaagtgtgtgcttataaatgtgtttagtttttaagctaaacattcagttaacagtctgtgcattgattagcatagggcaggtggtgaggacctggatttttattaaacagtttagtaattataaaagtttcttgtgtttactagtaaagaattttaaaaatctattctaattcaacaagtttttaaaatcaactttgtaatttgaggggaaaatttggggggaagaggtgggtgggccactaagttacctctctttcatttggtggcccttccaggccattgaaaataaagacgttggctccagtttgcacattgggaagaaagcatagaaatttgacttgtatattaaaaataatagaaatgtaatatgtatattaagaatgcataggtctgtattctgtaaggggctctgaagaacaatatggcactgctgtgttcagtgtgaattcactgcctgggagaactgcaggaatgcttgtcttcaccattgtgttcttacaacgaattcaactttccatggtttatcttgacaaaatttacatgtgtttaggttacttgtatattgatatatttttttaatcttcagtttttgtcttccttttgcctttgtgttttcagaagtaacacatgaacactttttaaagtacattacagagaagaaaactgtgagctattatatagtgtttcttttttaacacaaatcttttaactttaaaaaaaggcaaaaatttttttttctacttcccacccagcttaccaccttgatctctttaacttatgttctaaactttggtgttaatggtggtgtctagcatgctagtagttagattttatttagatgccataactggtaatacagcttttattttgactatattaatttagtttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtaggtttgtatttactcagtaaggaagtcagtgacctgaactacctataaaaattcagcagtgctgcagtgttgcttaagtgaaaccctttggctatctagtagtttttatgctactgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttattta

SEQ ID NO: 315521 - DNA, 3997 bp, Homo sapiens
ggaagcaataatgaaatagccatttcatatattgtacagcattgttaatgtgggtattgtctaaaaatgtgtaggttagattgagtataggaaggcttggtaccttaaagaagattgatgggacaagaaggaaaaaaaaactgcagtacctgtgagatttacttagagcaccttctctaggggaaaaaacccaattatattgttgtatttaactgcttaaaataatttagtaggttggaggctaggttggtcagtcttgtaccattttataaaatgggatttagccttactagattttttaaattttggtatattctaaacaaaaagtttcatacactattaaaatatgctagagagaaacagtattatacatgtatgtggttttgatattttttctttgtttttttcagagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctatgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 315522 - DNA, 2819 bp, Homo sapiens
taccgtgctgagctgatagatgaaagccactaaggtatagtctagatagattgtttatgcggacctgaaacctcggcatcacctggtcatcgactagtgcagccttgtgctcggggcccgctcgtagtgtatgacgacacattcatagtgctctagatatgatgtagttattaccgggccgtgcggtttaaaaagtttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 315523 - DNA, 1639 bp, Homo sapiens
aaaagagttgtctccctctaagagtatactattttcattcctccataaaagccaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 315524 - DNA, 4394 bp, Homo sapiens
cgcagcttgttggctcgctatataaaggagagaagcgggcggaccggacggctggagctgcagccggtggcggcagcggcggcgcagggagcggtgaccggtggtggtttccctccttggcgcggggtggggagcgggcaacgccccccggacccctgaagggtcgtggctttttttttttttttaaggcgattctcgaggttttcagctgcgggaggagtgcccccctcctcctcctctctccgctctcccctactccttcaggattgattttgtttaaaattttttccccaatcttgcggtgatttgggtcaccctccgggtgttaatagtttttttttttttggttttgtttttatcttgttttcttggggttgccccctcttgtttgtgttgtgtgtggaaatggcgaactcggcaaatacaaacaccgtgcctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctatgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 315525 - DNA, 4043 bp, Homo sapiens
gctttgcaagttcttcaccgcaaagaactgccgcagacttccgcctgggtgccaaccacgtgatcacgcgagcgttggagaggccctaaattatacagatctgtgattgaagatgtcattaatgatgtgagagacatctttctggatgatggagtggatgaacaagtactgatggaactaaaaactttatgggaaaacaaactaatgcagtccagggcagtagatggatttcattcagaagagcagcagcttctactgcaagttcaacagcagcatcaaccccagcagcagcagcatcaccaccatcaccatcatcagcaagctcagcctcagcagacagtacctcagcaagcgcagacccagcaggttcttattcctgcatcacagcaagccacagcaccacaagttattgttccagattctaagttgatacagcatatgaatgcatcaaacatgagtgctgctgctacagctgctaccttagcactccctgcaggtgtgactcctgttcagcagatattaacaaattcaggccagcttcttcaggtggtcagagcagccaatggtgcccaatatatctttcagcctcagcagtcagtggttctacaacaacaggttataccacaaatgcagcctggtggagtacaagctcctgttatacagcaggtgctggctcctcttcctggagggatttcaccacagacaggtgtcatcatccagcctcagcaaatcttatttacaggaaataagactcaagttatacctacgacagtggcagcacctacaccagcccaagcacagataactgcaactggccagcagcaaccgcaggcccagcctgctcaaacacaagctccattggtcttacaagttgatggaactggggatacatcatctgaagaagatgaagatgaagaagaagactatgatgatgatgaggaggaagacaaagagaaagatggagctgaagatgggcaggtggaagaagagcccctcaatagtgaagatgatgtgagtgatgaggaaggacaggaactctttgacacagaaaatgttgttgtatgccaatatgataagatacacagaagtaaaaacaaatggaaatttcatctcaaggatggcattatgaatcttaatggaagagattatatattttccaaagccattggagatgcagaatggtgaagagttgctttttttcttttataaataaaagaaacttaaaaaaaatgtaaagcggacagtttgaaacttggggcatatgccaaccaaaacttcgtttctgcatgtcagaaaagtgcagtagaagcaaagctatgaaacttggattactgtatgatattcagcttgtcttgggccctctatgtagacaaacattcatattcatagtagtgttgtatactggcctgtttttataactttatttttcaaatattaacaaccactgctttcagagtggttattttgttatttttgaagcaggaaataaccatttgtatttgcacctgcgtattgcatatgaattatggtatacttggcaaatgcttttcttttacctgtgaaaattctgaaagctggtccaagctacattgcataccaaattgtgctcttatatattatttgcatcgtgtcctttttaatcaaatagcatgttttagttttattatagtagcttttgctgtaagaatgtcacttgcttatcttttattgtacttgaattcttaatcatgcttttaacattgtatttaacaaatcatttcgtattaggttccattaaaatgtcattcctttgaaaaggcaagggatttccactttcagaatttgaaaatgaaagtagcatgtttatctaaaggcagaaaatagttcggacttggtattatgaaaataagtaatggtttctggagaggatttgtttagatttgcacagatggcgatggcaccttttacttaaattaacattaatcaacagtgctaaggaaaatttacacaaaattacaagataaaacatggaaatgtgtgcctttcagtatacaaactcttgcttggtggccatttgggtaatcagaccatttgaatgcctgagagcatgtttaatttctgtggagtgccacatatggctaaaacaactctttaatgtgcaattaatttctagagtaaaatgtctgttatgtgagggggatctttatgttgggcttttctattttttaaatgttcacatttctttctgttaattaaaatgccatcataatgtcacatttacactgttgcctcttttaaaagcaaagccactttcttgttctaagattacatcaagacttgagcagtgtgtagtaattaaaatgtgtgcttaatgagcataatagattctggttttaggaaataacatatagcttttatatgaatattttcttttgctataatgaaagtcacagattttttttttcctggcttttatggaggaatgaaaagagttgtctccctctaagagtatactatttttgattctcatagcaataatgtcaccattcttatcagagggtaaataccccttgtataggaaaacagacataatttcctcttgggagttctctttatgacttagcattttcttctacttgagaaaattcctgtttttccgattatttcatcttgaactttcttttttttaagcttttgtgcaatgtaatagtttgttgatccatctttgtacattttcattttatttcatgtctttctctcacctacctgtcagaatcagctatagcagattttgaattctttagttaaaaaatagttgctttacttgtttcctcatgagtttgttaaatagctttgcattttagtcctctattatgctatgaaaattattacgaagtttatattgttccctttttaagcctgccttactcttgtcttttgtcattgtctatggtttaatgaagaacacaccaaactaacatttttgtttattttgaggaacaaaaaaacttttctcttttaagggaagttactacacattgagttagtaactactctttcagtcaaggttccttaatcagtccagtctacatcaggactatgacttggggggcggggctaatcctttttgctgttctgagctactattgtcaactgctgttgtacatactgttatgtgtaatggcgtaaatatatttattatgtttgtaaaattcattgcagatcaaggttgctcttctgtgatatatgggatattatgttttaaagaccatcttggaatacaattagagaacttagtattttgatgtactaagacctattttaagtttaatattctactttgcaaaaactttaattaaagatgttatttaaaaaaaaatgttgcttgctttgcttactagtatatggcattgttatagataattgaataaaatacaatttagaaaggaaaatgctttacattgttaatgagaattccatttaacaacaacaaaaagatgctaaattctgtaccttaaagataagtagattgagatgtcaatttgaattagtaaactgtgttacaaatgattaatactagcttttaaaaagttgtattttccaggcacacaggaatttaggttgggcgaattcacactaacaaattataactaaaaattggtataattaacattgtttttcaaaataaagattactccttgtgaaatattaataattaacatattgtattaaataagtatttctactccaaagtatagattacttaggataaaaacattgttatttctctgtttagtcaaaccacttcctcttagttcagaggttataaataattgcatattaggagaattggattactgaggtttgtattgcgtattgaatatattttgtgttattttagaagataataattagcaggtattttaattttatagttaattcagctgaatcattaagaagctcgcctttttgtatttttttatcctgttaacagactatctagaaaacatgcaaattttaactattaacataatcataataaagatatcttatttattgccagc

SEQ ID NO: 315526 - DNA, 1581 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaa

SEQ ID NO: 315527 - DNA, 1056 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatgtgagtgaggagggcgccaggga

SEQ ID NO: 315528 - DNA, 891 bp, Homo sapiens
gcaggctgtaccgcccggaagtatgggataccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggccacaccacacccagccggacaacagcgaccaaaaaacaaggggggggcgcccccaaaaaaacccccgggggggccccaaatgggcaccccgtttttttaaaaagagggcccccag

SEQ ID NO: 315529 - DNA, 471 bp, Homo sapiens
  misc_feature (18)..(18): n is a, c, g, or t
gtagtgttctagaggatncctcctctggatgcaagtgtcccaaaatgctgggattacaggtgtgaaccaccacgtccggcctgtcctgcctactcttaaggactatggctttcaagagagcagatgactgtccccccagcacccacaggcctaatcagggcaggagctggtggctttgctgggaggggaagtgagtgggaagcagcgggccgctcggcgaggcacgcagcctgcttgagcaggagctctgaatggtttccttgccttgcacagccctgattgagtccctcaaccagaaaccacagactgccggtgaccaacccccacccacagacactttgcatccagaggacactttgcatccagagacactttgcatccagagacactttgcatccagagacactttgcatccagagacactttgcatccagagacactttgcatccagagacactttgcatcgggtac

SEQ ID NO: 315530 - DNA, 4418 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccggagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315531 - DNA, 3202 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315532 - DNA, 4308 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccggagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315533 - DNA, 3939 bp, Homo sapiens
gacgggagcagttgggggagggggaggggtggcgaggcgcggctacgcctgcgcactgaggcgcgcggtggctgctgggaggcgtagtttttccctcttgttcctctgcgggatgcgagccgtctggagactcgggcggccgggacttcagctttcggggtgctggcggagcccgctggggtttgaggtctccgagaatgaaacgcgctggcagccgggacgaagggaacttacctggaagtgaactcgaactacttttcccaaggggccgttcggtagcccaggccagtcgccggcctgggaaatattacagttcaggaaaataaacataactcctttaagggagagaatgggcgctagacagggagacatttctgttcttcgggcgccagggaaaggcgcttccgtatcttcactccctctcacctctcgggctgagggtcagggaccactctcccaaaatgcaagccggcctttgcacccaccccagtccgccgcctcggactgtcctgaagccgggcccctcactcctcccgatgatgagattcggagcgggtggcctggtgggaggtgctgacctcagccaccgccagtcctccatcgcccgcaagagtccagcggcggtcagccatgtggacgccgaggctgctgagttgccctggacaggagcctcctgagccagggagggaagagtgaagctggctttacaactcatcacctcgcttcacccgggaaccctttcttttttctttaacctaagttttccaaggagtttttcttaatccacgctagaggggagagagacaccgggtggtgcttgtgatcaccactcagtaaaccgtctgggaataacaggcactccgaagggcccagtctcatcctgacggctaccacgtgaccttcctgagcttgggtttcctcctcgggaagattagagggttggcgcagataatgtgattggcaataatacccatagggctttgcagtttaggaagctccttcacctgtgccttctcacttgagcctgccagtcagggatgcagagcaaagatcattatctttattctatgggtgaggaaaatctctgaggtaagggatgcccaggatgacacagctagaaagtaaaatgttctgtgactctgtaaatgtttatgaaggaaaagaaatgaaattgaggaacagcagtcagcctcctaaccggccctgcccgcctgatgagattgagaaagcggaacgctggtggaagaggtagcctggactgctgaactttcctccctccggactcttgcaggttgatctttggcctgtttgcctccccttggagagggtttcgggctgtatttgccaggacacctgagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315534 - DNA, 2743 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccggagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaa

SEQ ID NO: 315535 - DNA, 1527 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaa

SEQ ID NO: 315536 - DNA, 2003 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaaaaaaaaaaaaaaaaaaaaaaaaaaaaaaaaaaaaaaagaaaaaaaaaaaaaaaaaataaaaaaaaaaaaaaaaaaaagaaagagaaaggacagaaaaacacaacacagaaaacgagaagaataacaacattcaaaccgagaaatagccaagaaataacgatgggtcggatgttccaatagaaagcagcgatcgacagaccagaacgcctgtaaccgtcgcacgaccatccaaggtaacagcaggatactcgtcgtcggaaatgggatcccccaaaaatggtcaaagaaaagcgcgtctgtagacatcccacatcgggggacctacaaggatgggagagcaccatcaatgggaagaagcacaagccataccaggagcacttccacgcagcatccacgcagcacgtaccgggaatgtgccgccggaagcctcccacaagggaagcaggggaggcacacgcacacaagatcgcaccggt

SEQ ID NO: 315537 - DNA, 1484 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtgagtacatgggtgaggccgggccatgggcagacaaggggctttaaattctcagccccatcaggggccttctttcccatcctgatccagccagtgtgcgatcataatgcagaaacctggcttcgaatcaagaaaatatactttctctattcaactaggactcttaagctttttaggattatggtcccctaagaaattgcagcgagagctacagaacttttccctaaaactatgcacacatgtgcacacacatacacacacacgatacacatgtacacacacacacaatacatgcacacacataatacacatgcacacatacacgcacacatatacacaca

SEQ ID NO: 315538 - DNA, 2264 bp, Homo sapiens
gacgggagcagttgggggagggggaggggtggcgaggcgcggctacgcctgcgcactgaggcgcgcggtggctgctgggaggcgtagtttttccctcttgttcctctgcgggatgcgagccgtctggagactcgggcggccgggacttcagctttcggggtgctggcggagcccgctggggtttgaggtctccgagaatgaaacgcgctggcagccgggacgaagggaacttacctggaagtgaactcgaactacttttcccaaggggccgttcggtagcccaggccagtcgccggcctgggaaatattacagttcaggaaaataaacataactcctttaagggagagaatgggcgctagacagggagacatttctgttcttcgggcgccagggaaaggcgcttccgtatcttcactccctctcacctctcgggctgagggtcagggaccactctcccaaaatgcaagccggcctttgcacccaccccagtccgccgcctcggactgtcctgaagccgggcccctcactcctcccgatgatgagattcggagcgggtggcctggtgggaggtgctgacctcagccaccgccagtcctccatcgcccgcaagagtccagcggcggtcagccatgtggacgccgaggctgctgagttgccctggacaggagcctcctgagccagggagggaagagtgaagctggctttacaactcatcacctcgcttcacccgggaaccctttcttttttctttaacctaagttttccaaggagtttttcttaatccacgctagaggggagagagacaccgggtggtgcttgtgatcaccactcagtaaaccgtctgggaataacaggcactccgaagggcccagtctcatcctgacggctaccacgtgaccttcctgagcttgggtttcctcctcgggaagattagagggttggcgcagataatgtgattggcaataatacccatagggctttgcagtttaggaagctccttcacctgtgccttctcacttgagcctgccagtcagggatgcagagcaaagatcattatctttattctatgggtgaggaaaatctctgaggtaagggatgcccaggatgacacagctagaaagtaaaatgttctgtgactctgtaaatgtttatgaaggaaaagaaatgaaattgaggaacagcagtcagcctcctaaccggccctgcccgcctgatgagattgagaaagcggaacgctggtggaagaggtagcctggactgctgaactttcctccctccggactcttgcaggttgatctttggcctgtttgcctccccttggagagggtttcgggctgtatttgccaggacacctgagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaa

SEQ ID NO: 315539 - DNA, 839 bp, Homo sapiens
  misc_feature (794)..(794): n is a, c, g, or t
  misc_feature (796)..(796): n is a, c, g, or t
  misc_feature (801)..(801): n is a, c, g, or t
  misc_feature (803)..(803): n is a, c, g, or t
  misc_feature (805)..(805): n is a, c, g, or t
cgctgccttttcctcagactctcctttcagggagtgtgcgggtccctgctctggtttgagagggaaccaactactcctctggtctgtgcggcacctcctgtcttggggcccatacccctagagtgccctgggcatggggacccgcacccactttgaacctggtatttctggccaggtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaacgtgtgaggcncngggtntngncattcaggatagcagaggctcccacagccatctg

SEQ ID NO: 315540 - DNA, 3256 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315541 - DNA, 3104 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttcccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315542 - DNA, 2585 bp, Homo sapiens
acccacgcgtccgcggacgcgtgggtcgacccacgcgtcgggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315543 - DNA, 3302 bp, Homo sapiens
aaaaagcgggaccactcacagagatactccacagacttcactactttaatcaccaccactgagtccacatcccacagtacaacctgccggtggccaccggcaggtagtactctttaacctaagttttccaaggagtttttcttaatccacgctagaggggagagagacaccgggtggtgcttgtgatcaccactcagtaaaccgtctgggaataacaggcactccgaagggcccagtctcatcctgacggctaccacgtgaccttcctgagcttgggtttcctcctcgggaagattagagggttggcgcagataatgtgattggcaataatacccatagggctttgcagtttaggaagctccttcacctgtgccttctcacttgagcctgccagtcagggatgcagagcaaagatcattatctttattctatgggtgaggaaaatctctgaggtaagggatgcccaggatgacacagctagaaagtaaaatgttctgtgactctgtaaatgtttatgaaggaaaagaaatgaaattgaggaacagcagtcagcctcctaaccggccctgcccgcctgatgagattgagaaagcggaacgctggtggaagaggtagcctggactgctgaactttcctccctccggactcttgcaggttgatctttggcctgtttgcctccccttggagagggtttcgggctgtatttgccaggacacctgagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315544 - DNA, 3450 bp, Homo sapiens
cgctgccttttcctcagactctcctttcagggagtgtgcgggtccctgctctggtttgagagggaaccaactactcctctggtctgtgcggcacctcctgtcttggggcccatacccctagagtgccctgggcatggggacccgcacccactttgaacctggtatttctggccaggtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaagtatgagccagggctgcctccaccctgcaactcctggcagctttggccctggtcatgagcagaggagggagggggagaaagggaggaagcctggtgattgtggcaaagactcctgtccccagcctgacctccagcctccagagaccgagcagctgtggggcctgctgggaaaccaaggtcggtttccgccctctagcgatgctgtcctccccactcctccgctctgctccctggctccaggggtgtgggggaccccagaaccaggcagagtgggaacttgaaactgttgctgagggccacccggggcttcttggtccactccagccatcagtcagcacggccctttctccagcacagcagactattgtccgtgccctggtatttaggccatcacatatggtggggcccaagagagccccatatgcacactgcctgcctgataccaggaagaaccatgtgggaataggtgggccaagagccctcccctttctccatccctccagctaggaggaaatggagcaagatgaacaggcagccacgaggtgggtgggagctggcagtcttggtggcggcaggggccgcgggccctgaccacccccctctggtgggatctgaggcactctctcgaatgccgtcacacctggcagcctggaagccacaggcatccggccttgcccaggcatctcgcctgcggtctgaggaagggaacagaaggtcatgagttcagggtcagacgcagccgctcagcacaggaggggtggaggggaaatgagagttgctggtagcaggctccctccttctgcagcccggcgaatgggggcgctgggctctgttcccagcgtttgccagaggtggccacttcagccaagcccggagaagtgtgggcagaagcagtgaaggttcttctctgtgtgggtgccctgcccaccccctcctttgcctgtgtcctcccggcctggatccatggctgactctgcctggaggccatttgtgcctgcctctgtgctgccgcaggagggcaggccgcaagtggggttggtgggggtcgagcgggcagcacggtgcagcggtgcagtggcaaggggggctacttgtgtggcataagctagaggagccggtgccgcctgaatgccgagctaactgttgccactctcctccccagactatgaaatccctggagaatttttggtgacatgcactgagccaaggtgatggactgtatatttgaggaaagacaaacaaagaaacaaaattaaaatggaattggaggccgaacgctgcacagctgccctctctctcacccagtaaatgcagaaagctcttaggacagacagaaaacctgccatggggctgcttccctccctcgcagggctggcggaggctccgcatcgcctctctcctaggatacagaaaccatggcaacgaaagtagaatgtaaaactcgcagcagatatcagtgggaagggctgggggagggggcacccagctgcctttcctccctcacaggagccaccaccagccacctctcaggagaagccagaggccctggccaaagataggaggaagaaagagaactctccatagaatgtaatttatagatgcgtgtatatgtatatatatctatttatatgtaaataggcatatatgaagatatatatatatatagtctactttttaaactctgcagggatttggttaagttgttgagctgatttcttccatgttttagaaaatgaggcctgtttggggaaggtaccctggtgatgtttttgctagacattagctgtagctgacagcataaggagagtcgcatcagagcttttcacagccccccgaaaccccagcctggttttgatggcagcagtaatcatgatagtgtgaacccgcgaaggcctcaggattatggttaacctggagaggagcaggccatggaggcaggtgccaggtcagtattgagtcacagtagaggccccacaaggacctgcttgggtgagaccacctctcccctctcagcagcgctggtgggctctttgtcctggtgcccaggagccctccagccccctgcccacagaagggaaggcctgcagagggggccaggatctacctaaccatttccccacccctaagtccctcagtgggctttgccttataggtgccacagggcacagctccatcattgccactggtttttcctaagtcatgcaccaaggacttcagaaagttcttcctccgagtcagtcagtggtgccgggaccccagggcagcctcctcgactcctgaagaaaaggcagtgcccgtggctgcctctgtcttcactcgctgttgatgtgaccgccaggcctcctctcgtaccttggacaaaggatacacctgaaccagaatagttttcttaccctcacattgaaatgaggattttgcttaaaacagcacttgccgccagtgggaggagggaggttttatttattcccacagtttctcctgggccttctggaatgaccatgttttcctgtggcggtgggtgtgtcattgcgcccgccgtcttccaaagccttacttccccaagctgccagccaggaggtgataaccaccctcccagagtttctctcggctctttttttaaaagtcccccaacaaataggattcttgctgggaaaggaagttcggtaaggaaatgtcaaatctggtttttaaacaaggtccaaccctgcaatgaagcagccacttcagcccagagagattataagaactgatgtggccagagtgcctacccactgtggccccggtgctctgcccccacgccccgaccatctggtcttggtagatgtccctagacgggctgagccatgtgcaataagaacatagatcctaaaggatcctctggaagctgtatttcttgaattagaattctcaaattgtacatctgttaatatatgtttattatgtgactggc

SEQ ID NO: 315545 - DNA, 1563 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgatggcgggctaggggtgtttgtgcagctgatgcctatcctcatcctgattctcgtgtcagctctcagccagctcatggtctccagtccaccctacagtctgagtccaagaccgtccgtgggccacatccacaggcgagtcactgaccacctgggtgtcgtctactatgtgggagacactttctccgaagagtacacaggctccagcctcaaaacagtcgagcggaatgtggaagatgattatatcgccaacctccggaacaactgctggaaggagaagcagcagaaggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaagcgtcgcgctgggtcctcgggcagc

SEQ ID NO: 315546 - DNA, 1298 bp, Homo sapiens
ccgacggctaccacgtgaccttcctgagcttgggtttcctcctccggaagattagagggttggcgcatactcaactctaagacctccggaacatggaatctgggcgtgcaccattattgacacctacaccagccgtccctttcttagaagacatacggtagcacttccaccctcgctcaaaactcgggaaaggaggggcggagggtggatgtcatcactccgcgcccggctgcccgcgacgcgccggcgggtggcgcagcccttcgctcgcccggcctccccctccctggttccgcgttctggttccgccatggaatccaacaaggatgaagctgagcgctgtatcagcatcgccctcaaggccatccagagcaaccagcccgaccgggcgctccgcttcctggagaaggcacagcggctgtatccgacgccgcgagttcgcgccctgattgagtccctcaaccagaaaccacagactgccggtgaccaacccccacccacagacacaacccatgccacccacaggaaagcaggtgggaccgatgccccctcggccaacggtgaagctggaggagagagcaccaaaggctacactgcagaacaggttgcagctgtgaaaagggtcaagcaatgtaaagattactatgagatcctgggggtgagcagaggggcctcggatgaggacctgaagaaggcctaccgcagactggccctcaaattccacccagacaagaaccacgcacctggtgccactgaagccttcaaagccattggcacagcatatgcggtactcagcaacccggagaagaggaagcagtatgaccagttcggcgatgacaagagccaggcggcccggcacggccatgggcatggggatttccaccgtggctttgaggccgacatctcccctgaagacctcttcaacatgttctttggcggcggcttcccttctagtaacgtccacgtctacagcaacggccgcatgcgctatacctaccagcaaaggcaggaccgcagggacaaccagggtgataggaaggcttgctgtaccgggcacgctactttggcgacacagatatgtaccacagagcacagaagatgggcacccccagctgcagccgactgtcagaggtgcaggcctccctgcatggatagtcctgggccagccacaccaccgaggtccaaactatgaaatccctggagaatttttggtgacatgcactgagccaaggtgatggactgtatatttgaggaaagacaaacaaagaaacaaaattaaaatggaattggaggccgaa

SEQ ID NO: 315547 - DNA, 294 bp, Homo sapiens
tcacagaattggtgtttgtgcactgttaattaaataaacattaaatagagtgaatgcttgccgtagttagggacgtctttgcaaaaagccccctagctgttcagggataaataatgtaggagtaccagaggagtttatgtattgctggccttgctatggaatctcagtgcttcagagccaacacaatgttttatgcaagttagatccccaggcgacacttggtcctcaagtttgctgacttttcaagtagaaggagaagaaatagtgcacaatttcaaatgaagaatacttact

SEQ ID NO: 315548 - DNA, 1547 bp, Homo sapiens
ccaaattattgtatctcacagtgtggggaaaaggaagagagatcagattgttactgtgtctgtgtagaaagaagtagacataggagactccattttgttatgtactaagaaaaattcttctgccttgagattctgttaatctataaccttaccccccaaccccgtgctctctgaaacatgtgctgtgtcctctcagaattggttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtcgatgttgagaatggtatttcttcagttttattttaggatttctatagtttgatgatc

SEQ ID NO: 315549 - DNA, 727 bp, Homo sapiens
tgaaatataagaaatttccaagtaaaaacctttgaacacggcattttttttataagaaaaaggttttcccgggttggccattttgtaaaaggggcaaaacaccccaacctgttaaaggggacataaattataaggtgggcaccctcccgccctttattctcctatcaattggtaagtgaagtcttgggcccttgcggccctttgcctccttaaacaataaaggcaatgttgcttcgtgaccaagtgcttttggaaattaggctttcaattcctaaaggcgaatagacccaaacatggtgtgcctgtataaagaggattgatagatttctttccaagagaatttagacatattctctctctgtcaccaaggctggagtacagtgctgtattcagggctcaatccaagctccgcctccaaaatgctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315550 - DNA, 422 bp, Homo sapiens
taagatcttcctttggcaagccttctctaattaaaataggcaagtccgtggcaaaaatctgtaattcatcagataagaaaagaaaaggcccaagtataatacagtgacaaaaaaaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315551 - DNA, 422 bp, Homo sapiens
  misc_feature (15)..(15): n is a, c, g, or t
agcctcccgagtagntgagactatgggtgtgcaccaccacacctggctagtttttgtatttttttgtagagacagggtttcaccatgttgctcaggctggtcttgaactcttgagcgctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315552 - DNA, 412 bp, Homo sapiens
tttaaaaaattttttttattatattttatttttttgagacagggtcttgatatttttttgggacagggttacctggggctccaagtgaatccctttctcctcagccgctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315553 - DNA, 413 bp, Homo sapiens
  misc_feature (24)..(24): n is a, c, g, or t
gtaggctttcaagtcctaagcccnacccctcctatcccacctaggcagaaatcacttcagatccttgcttcctagtttaatttcttctctgcctcagttataacatccataaaatggaaataataatacccacctcacacaggggttaggagtgtttttttgttggttttttgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315554 - DNA, 751 bp, Homo sapiens
  misc_feature (37)..(37): n is a, c, g, or t
  misc_feature (138)..(138): n is a, c, g, or t
  misc_feature (211)..(211): n is a, c, g, or t
  misc_feature (217)..(217): n is a, c, g, or t
cccccaccacacagcaaatgtgctgatctggttgggntctgtttgcttcactgcaagtttaatcctgagacatattggcttatgcattttatatttataagacttcctgttaggtatagaaagtgaacatagaatctntttgtgtatttctattaaaaaagagagaagactgtgcccccccaaaggaaaaaaaaaaggcgccttctttttnaaaggntggccatatgggtacaggataaagatatccatttaaataacccattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctccctgaaaacatatatttcacgtgttccctcttttttttttttttttttgtgagatggggtctcggtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315555 - DNA, 386 bp, Homo sapiens
tgggccttaacccagagtttctggttcactggatctaggtagggccaaacaatatgcacttttttttttgtttgtttgtttgtttgttttttgagacagagtttctctatgttacccagttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315556 - DNA, 2273 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatgcaaaagttagcggggcgtggtggcgggtgcatgtagtcccagctactcgggaggctgaggcaggagaattgcttgaacccaggaggcggaggttgcagtgagctgagattgtgccactgcactccagcctaggtgacagcaagactctgtctcaaaaaaaaaaaatggcacatcaacgagagggaggcttggagaatatttggttggtgggcgggcagggactgccagagggttaggtgtacattgaggcctgaggctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatc

SEQ ID NO: 315557 - DNA, 1965 bp, Homo sapiens
  misc_feature (1526)..(1526): n is a, c, g, or t
  misc_feature (1530)..(1530): n is a, c, g, or t
  misc_feature (1541)..(1541): n is a, c, g, or t
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgaaaaaaaaaaaaaaacaaaaaaaaaaaaaaaaanaaanaacaaacaganagtatacagaagacacagcaaaaaatagagaggggggggcgcgccgtgacaagtatcttcaccccttgggggacgcccctttttgttctggctgtcccgcgtctttttttttgattgaaaggggggcccccattaatggggaggcgctgctattttatatcctgcgcgacgtggccgccgtcttctttcgcatcccgcctcgcctcgcggtgtcgcagtagctcctgcgtcgtggcgcctctctgtggcgctccagcgcccctctcttccgttcgcgcggggtcccaatattggggggaccagctgctccgtcgagatttatagctgcgcgggggcatatcgcacttcgcgcgttttctggtggtcgtccctcgccgcatgtgcggcgggccaagaggctggtcgctccagcgtcttttcggca

SEQ ID NO: 315558 - DNA, 1586 bp, Homo sapiens
ccaaattattgtatctcacagtgtggggaaaaggaagagagatcagattgttactgtgtctgtgtagaaagaagtagacataggagactccattttgttatgtactaagaaaaattcttctgccttgagattctgttaatctataaccttaccccccaaccccgtgctctctgaaacatgtgctgtgtcctctcagaattggttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315559 - DNA, 1376 bp, Homo sapiens
  misc_feature (31)..(31): n is a, c, g, or t
  misc_feature (33)..(33): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (46)..(46): n is a, c, g, or t
cttccgaagtgtcgcgcgtgagtgcgggttntntacgtntnanttnccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315560 - DNA, 1762 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagattctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315561 - DNA, 1909 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagattctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315562 - DNA, 1770 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315563 - DNA, 1655 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagattctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315564 - DNA, 1456 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagatctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315565 - DNA, 2177 bp, Homo sapiens
gccccctaatgggtggctgcgctgagccagctcctcagattaccaccttattggccgcctttctcagcttttctgtagttacccatattttgttcctctttcttgtctattttctgtgctttttctctgctttccgtctcgctattttgtcacatctccattttctttctccttcctgtcaccattcttcatgttcttcccacaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315566 - DNA, 2494 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315567 - DNA, 918 bp, Homo sapiens
  misc_feature (36)..(36): n is a, c, g, or t
  misc_feature (38)..(38): n is a, c, g, or t
  misc_feature (57)..(58): n is a, c, g, or t
  misc_feature (61)..(61): n is a, c, g, or t
  misc_feature (68)..(68): n is a, c, g, or t
cgtacacagaatgttaaacccgattgctaacatgcncnccaatgaaaacaattgaannccnttggaanaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaagctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315568 - DNA, 1193 bp, Homo sapiens
  misc_feature (24)..(24): n is a, c, g, or t
gtaggctttcaagtcctaagcccnacccctcctatcccacctaggcagaaatcacttcagatccttgcttcctagtttaatttcttctctgcctcagttataacatccataaaatggaaataataatacccacctcacacaggggttaggagtgtttttttgttggttttttgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatgcaaaagttagcggggcgtggtggcgggtgcatgtagtcccagctactcgggaggctgaggcaggagaattgcttgaacccaggaggcggaggttgcagtgagctgagattgtgccactgcactccagcctaggtgacagcaagactctgtctcaaaaaaaaaaaatggcacatcaacgagagggaggcttggagaatatttggttggtgggcgggcagggactgccagagggttaggtgtacattgaggcctgaggctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatc

SEQ ID NO: 315569 - DNA, 1531 bp, Homo sapiens
gccccctaatgggtggctgcgctgagccagctcctcagattaccaccttattggccgcctttctcagcttttctgtagttacccatattttgttcctctttcttgtctattttctgtgctttttctctgctttccgtctcgctattttgtcacatctccattttctttctccttcctgtcaccattcttcatgttcttcccacaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315570 - DNA, 1493 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315571 - DNA, 240 bp, Homo sapiens
gcggccgcctactactactactactactgctcgaattcaagcttctaacgatgtacgggaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315572 - DNA, 1443 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaagctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315573 - DNA, 1217 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgttggccaggcgggcctcgaactcctgacctcaagtgatctgcccgcctcggcctcccaaagtgctgggatgacgagcgtgagccaccgcgcccagccatccctgccttcctcttatggtctattcacgccagctccttgtacctgccagg

SEQ ID NO: 315574 - DNA, 2139 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315575 - DNA, 1735 bp, Homo sapiens
  misc_feature (23)..(24): n is a, c, g, or t
  misc_feature (46)..(46): n is a, c, g, or t
  misc_feature (48)..(48): n is a, c, g, or t
gagcctatatgggttacacctanntagaaacccccctttggcgttnanaacagtgtcggcgatctgatcgcgcaccgtctggttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagattctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315576 - DNA, 1386 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315577 - DNA, 2186 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagattctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315578 - DNA, 1848 bp, Homo sapiens
gctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcactgaagcatcttattttatagtatatcaacctttgtttttaaattgacctgccaaggtagctgaagaccttttagacagttccatcttttttttaatttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctga

SEQ ID NO: 315579 - DNA, 1247 bp, Homo sapiens
cgtccgcggaaatttgaaatggctgacgggtcgctgacgggcggcggtctggaggcagcggccatggcgccggagcgcacgggctgggcggtggagcaggagctggcgtctctggagaaagtttttcagaagaagtgaagtcaaagatgcaagaaccatttgctatttctggggagtcctggcggtttcttattacaggctgttcatgtgaacgcccaacgccgatgacacaggctgtacttgtagacaacccactgtcacgtgtgcccggattacttccacggatcatccgtacttccgaagatcctaaatgaggacatggtggcaggagacaaatccgaattatgttcctctgaaaaacagggacgactatctctggatccaactccacattgagaaccagcattgtgtaccatgtggtcttgacctctggtacacaacatgtgatccctacagaaagtgggagccggactcactcagcatagattacctggatacccagaagcaattatctgtggcatgcacgaccagtggctaccagcaggacctgctaccattcttgacacgacaacaacgttcctaccaacagctgtgagtacacacctcagaaatatgagaggctgagaccccacaatgggtggacaacagactttaagcccactgatggcttggataagacatggaataaatttcacgtcacgtgagctagaagggccttcgatcttttcgttgagagggcgcacaatcgtgaatacacaaagtaagcacatttaataaccaatgaatgtatgaacccaggagcattagaaacacagccggggacggcgaacagcaccgaccaccgcgcggaccaaaaaaaagacgacgtcacaggggcgcaagaaaaacgggcaaacagtcagccctgaccggagcagcccccgaagtaacaaaaatcgaacgacaaccgtcacaaaagaaggagatcgccccacacgaccacggaacacgaacacccacaaacaggcgaaaaaacacacggcgaaccgacagcgacaacacagcagaacccccaccagaaatgcaaccatgacacacaaaagataagagacagaaaacacagcgcacaaagcacaaagcgacgaccaaaagagagacaaaacgacgcaaaaggaacaaacaaagcacaacaagccagcggacaaacaaccaacgaagcacgaaaacgcaacaaaaaggggcgcgcccccgcccgcagggggagagga

SEQ ID NO: 315580 - DNA, 3218 bp, Homo sapiens
cgtccgcggaaatttgaaatggctgacgggtcgctgacgggcggcggtctggaggcagcggccatggcgccggagcgcacgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgactccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtggtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaattgaa

SEQ ID NO: 315581 - DNA, 3055 bp, Homo sapiens
cgtccgcggaaatttgaaatggctgacgggtcgctgacgggcggcggtctggaggcagcggccatggcgccggagcgcacgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgcattatgacattcttgaagaccgagttccatcaggacttattgttgactaccacaatctgttgtctcaatgtgaggagagttacaggaaatttttaaatctgagaagcagtttgtcaaattgtaactctgactccgagcaggaaaatatctccatggtggaagggttaaaattgtattcggagatggaacagttgaaacaaaagctgaaactcattgagaatcctttgttgaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtggtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaaaaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaattgaa

SEQ ID NO: 315582 - DNA, 356 bp, Homo sapiens
atgactatcaaccatagcaaatatgcagcattctctaagatatgagaattgttttgatttactctttagctctcacccctccaaaatcctaatgttttgagccagtgatagaatttgaatgatactaagttccatttcagatttttctaccaaaacatttggaggagttgggatgaagaagaggaggatgaatacgattattttgtcagatgtgttgaacctcgattaagattgtaagtatttattgctgaccttgttgtacatgttggaaaaatagttacccatggtttaattttgcctgtgtgagatacacacacacacacacacccacactcactcactcactctctctctct

SEQ ID NO: 315583 - DNA, 2984 bp, Homo sapiens
cgtccgcggaaatttgaaatggctgacgggtcgctgacgggcggcggtctggaggcagcggccatggcgccggagcgcacgggctgggcggtggagcaggagctggcgtctctggagaaaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttagctgactgcaaggcctctgaggtacaggaattcacagctgagttcttggagaaggtccttgagccatctggatggcgggcagtctggcacactaatgtgttcaaggtgctggttgagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcagatttttctaccaaaacatttggaggagttgggatgaagaagaggaggatgaatacgattattttgtcagatgtgttgaacctcgattaagattgtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcagttccatagtgatccattgtctgctataaatgcctgcttcgaaggtgacactgttattgtttgtcctggccattatgtggtacatggcactttctccattgctgactccattgagttggaaggatatggcctaccagatgacattgtgatagaaaagaggggcaaaggcgacacttttgtggactgcactggtgctgatattaaaatctcaggcataaaatttgttcagcatgatgctgtagagggaatcttaattgttcaccgtggtaagactacgctggaaaactgtgtgctgcagtgtgagacgaccggagtcacagtgcggacatcagcagagtttctaatgaagaactcggatttatatggcgccaagggtgctggtatagaaatctaccctgggagtcagtgcaccctgagtgacaatgggatccatcactgcaaggaagggatcctcattaaggacttcttagatgaacattatgacattcccaagatatccatggtgaataatataatacataataatgaaggttatggtgttgtcttggtgaaacctacaatcttctctgacctgcaagaaaatgctgaagatggaactgaagaaaataaagcgcttaaaattcagacaagtggagagccagatgtggctgaaagagtggatctagaagagctgattgagtgtgcaactggtaaaatggagctttgtgcaagaactgacccttctgagcaagtcgagggaaattgtgaaattgtaaatgaactaattgctgcctccacacagaaaggccagataaagaagaaaaggttgagtgaactggggatcacgcaagctgatgacaacttaatgtcacaggagatgtttgttgggattgtggggaaccagttcaagtggaatgggaaaggtagttttggcacatttcttttctgactacagtgatgtaagtagatagcaaaatactggattttgcacatgctgccctaagaatcactgctgccattgtagtttgctgtattgtctgtattttatatttgattatttgggcttgagtgaaaggtagatttatttccatttgcaggtgttgcacataaaacactccctctttataagaaaaatcataaatgcatataaaatagaaaatatttggagattgcttatctgaaagtcttgctttcttatacacatggttctctcatattaagcctggtggtaactttttagtgtaattacctttagcacttcaaagacgaggaagtaaggaagggaatgcaagactagtgcataaaaatgcaataggtgtcatatgtacagcattcttcttagagttgccttttcatcccaattacagtgagtctgatttccatcctgtatttgcataatacttgtcttaaaataaaagcttttatgattgggaatttatctgcctaatcagacttattattgagacgtcaatgggacgcatttttctgttgagctatgcagtcgtcaaaacagcgatagacagcataggaggtttgaagcagaaatgaaatgtgttattcagagccaatgttgtacatagagcattttcactattgctgaatgggaatgattaaaaacaaggtatttttcgggccaggcggtggctcacgcttgtaatcgcagcactttgggaggctgaggcaggaggatcacttgagcccaggagttcaagactagcctaggcaacatagtgagaccctgtctctactaaaaataaatttaaaaaaaattagctgagtgtggtggtgcatgcatgtagttccagctactcaggaggctgaggctagaggatccttgagcccaggaggttgaggctgcagtgaggtgtgattgcgccactgcattccagcttgggcgacagagcgagacccagtctcaaaaaaaaaaaaaaagtatttttctcttaccgttacagtattctgattatattactgacacagtcaaaatgattaactgtacaacctgtatctgctgggtgttcttgttatcatattgtaaaacagctttaaaaatatttatattttaaaaactgtatgtgacattaatatgcctaatgattaaaattatagtgatgaaataacaaaattgaa

SEQ ID NO: 315584 - DNA, 2408 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagc

SEQ ID NO: 315585 - DNA, 3320 bp, Homo sapiens
ggacggcgtgggtcgacccacgcgtcgccacgcgtccggccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatccttgaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcagtccccatttatctgcctgtgtaccactcagtttagtaacctctaggcagc

SEQ ID NO: 315586 - DNA, 3324 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaggtagttgttactcattttgaatataccttttccttattgtattctgtaatataggatccttgaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcagtccccatttatctgcctgtgtaccactcagtttagtaacctctaggcagc

SEQ ID NO: 315587 - DNA, 2214 bp, Homo sapiens
agtgtcgtaaacgtcggatatccggttcttctgggcgctaagggagctgacggagagggccaccgcccagcaatagacgtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagc

SEQ ID NO: 315588 - DNA, 1222 bp, Homo sapiens
gtgatgtctcttggtttttaaactttttctaattaagaatattcttctcttctagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagc

SEQ ID NO: 315589 - DNA, 1838 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgtacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagc

SEQ ID NO: 315590 - DNA, 1225 bp, Homo sapiens
gcatttacaaagtaaaagcatgcactgttaatacactttagatgtttctcaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatccttgaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcagtccccatttatctgcctgtgtaccactcagtttagtaacctctaggcagc

SEQ ID NO: 315591 - DNA, 583 bp, Homo sapiens
attttgttaccatgagagtccactctcacgaagaacctaattatagaaacacctaatgattatagaaatagagaattctactcatatttaattgggttatgttccctctccataagtaaatggtaatggtctgacttagttgagttcaggcagctgttacaatttgaactgagagtactgggtgtccgttttaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaaggtaaagtttcatacaaggtagttatagtgctacagtgatgtctcttggtttttaaactttttctaattaagaatattcttctcttctagttactacagtgtggagtgttgagaccagacaccttttgctgtctcatggggcagctacaagcatgaacgggaccagggaatggcagc

SEQ ID NO: 315592 - DNA, 333 bp, Homo sapiens
atgatactgaagatctgattctgttttgccacttaataactagtaacaggtttaaaataggaactaatttagtctgttcatttgctatgcacatggttggcttcaccaagtaaaagtaaacgtgtcttttatttagttatctaaatgatctggatagaatatcccagtctaactacattccaactcagcaagatgttcttcggacgagagtgaagaccacaggcattgtagaaacacatttcaccttcaaagacctatacttcaagtaagtcattagcctttttgctaggtgtgccaaatacaagtatctttcattttagtttaccatctctt

SEQ ID NO: 315593 - DNA, 288 bp, Homo sapiens
tactcattttgaatataccttttccttattgtattctgtaatataggatccttgaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcagtccccatttatctgcctgtgtaccatttacatttgctctctgtt

SEQ ID NO: 315594 - DNA, 3378 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatccttgaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcagtccccatttatctgcctgtgtaccactcagtttagtaacctctaggcagc

SEQ ID NO: 315595 - DNA, 3331 bp, Homo sapiens
ggcgacagaaaaaaaaatgctaggtcgggcgggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatccttgaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcagtccccatttatctgcctgtgtaccactcagtttagtaacctctaggcagc

SEQ ID NO: 315596 - DNA, 2821 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggagtgacagcaattatcttctgtgtggccctcagtgattatgaccttgttctggctgaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcaaaaaaaaaaaaaaaaaaaaaaaaaaaaaaaaaaggggggggggtttaaaagtttttccctgggggggccccaggttttggcttttccccggttttttttttaaagggggccccttatagggggggggtttttaaaggaaggagggggcggggttttaacaggtgggggggggaacacccgggctttcgggggctccttgggggaggggacccttccttcgtgggcggggcgccttctatgcgggacaccttcccttaccggaggtttaagcggctctatgggtcccttcttatcttttccacgtttgtttggtggtggtacccctcgcggtattatgctgccggcttgaagtatttcggcttcacggggttctgtttttggacatttttttcccggcgtgttgtctaaatcg

SEQ ID NO: 315597 - DNA, 1633 bp, Homo sapiens
  misc_feature (49)..(49): n is a, c, g, or t
aggcttatataaagagtgttgatgtaggtgccaaaggtagagttggagntgacagcaattatcttctgtgtgctcagtattcggtaggacgaggagatgaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagc

SEQ ID NO: 315598 - DNA, 899 bp, Homo sapiens
agtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgctggagaatctggtaaaagcaccattgtgaaacagatgaaaatcattcatgaggatggctattcagaggatgaatgtaaacaatataaagtagttgtctacagcaatactatacagtccatcattgcaatcataagagccatgggacggctaaagattgactttggggaagctgccagggcagatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatattatctaaatgatctggatagaatatcccagtctaactacattccaactcagcaagatgttcttcggacgagagtgaagaccacaggcattgtagaaacacatttcaccttcaaagacctatacttcaagatgtttgatgtaggtggccaaagatcagaacgaaaaaagtggattcactgttttgagggtttcgatgatcatcgaaaccctaagtatgaggatgagatcaataagcgtacagagatggagaacgaatttgtcctcatcaagaagggtttgatga

SEQ ID NO: 315599 - DNA, 1003 bp, Homo sapiens
gtgctcaaaaagggccggtgtgccgcagtgagtgccagtttgaatgaaggaagcatgcgtggcctgaagcctcaccgtgttccaggcgtccagttaagtgctctgcacataatatcacacattgcgctccacgataagaacaaattctcacatgggaaccgagcaaagtgtaatggatgttcccaggagctgcctatgggattcaagaaaactgtatgagaggagtaacatttgggctggaagcgaaaatacaagtaaacatatgtcaaatggggtctggaaagcaatcctccacagaaagaaagcagaatcttctgggcatttctgagcaagtggacttccttcagctgagcacagtcctcaggagaagcggacaggtgcaaagtgttggaagccaacactcacagcagttgggggttggagtgctctggcttccaacagcattgaaaccaacagcattgactacagcgagtttctcaatcttcagaacacatcccagcctccctgggggctgctaatgcacagattgccgtttcccactccaagagtttctgattccagaggtctggggtagggctcgataatttgttcttctaaccacctaatgctgttggtccagtgaccacactttgagaaatgctgtactatgttttctcatatatttaaaaattctcacctcatttatggtttaaaacttctagaacaattctgaatagtttttgtaatagtgagcctcactttcctgtctctgcccttaatgggaatgtctctaatgattcacctttcatacggggacttgttgtggtttactgggcaattccttttggcaggttaaaaaaattccctctgtttcaagctaaagccatttaccaggaagagacgctaagttttatcagagggtttttccagtaactattgtgataatcatggttttttttcctatttattacgatatcaaacatgaaacttatttgaagtcctggattaaacggtgcttgttttc

SEQ ID NO: 315600 - DNA, 3754 bp, Homo sapiens
cagtaattaggtagctccctgattgtttctaattctgctattaattgtgaggagcggggagtgtgattgaggataaatttggtgcggagctgctggggcttcagctccccgtgagttccctgggctgccttccacccctccaggctgcagaggcagcttcctccctttgcctccatcctgctctgcctaagtttcctattctctttccacattttcctcctccaaggctggggagctttgggactgggaagcccaggcagacctcgcctagagagaggtgtccgtctggctctcctgagtgtggcccagctacagttggcaggactggtcctctcctcctcccagtgccctgcgcccctcccctcctctgcctcccttcttcccacacttctccaactctcccctcaccagccagtggcccagctgaggtactcagttccagccccaagctggatcctcccccatctccccactccaaccggaagaagcaccggaggaaaaagagcaccgggaccccccgaccagacggccccagcagtgctactgaaggttagggggacccagagggaaaccgggcacaggaggtgggcagtgggacttggggatagtaccctaaaagtaacacctattttttattttttgtattcagtggattaagcactttctagtagttgctaatcaaagtagttctacagcttcttttggtaatctagacctggtatcttagaaaagttcttctgataactgaaaccctttctgttgaaatgtgggcttacttcatttattcttaaggtaaaagacagcagactgctacatcaatagctcctctaagatgttcgggcaggacctgtgttttctgtctcttgtgtcatactgagtttaataaagtgctgggtacttactaggtgcgtaatacatgtgtacagattggctgagtctctcattagttttccttaggctaaggaattccaggtcctgaagccttcttccataggacctttctcttcctctattaattatactgctgctcctcagattttcctcaaagtatcttcaaaacctccctcttcttggtgattggagtttctttgctcccaaataagtttaacttctacagactcataatttctcacttctgctctaatcatcagggtagacgtatgggtcaggggagcagagacacctagccaacctgtgacacagtgatgcttagtacttacagcgtggggtctcccttctggtccggcagactaagccccacaaatgatcatggagatcacgtagttcgaaggctgtggttgaaagcaaggtgaggcgcagtggtggtgcctggggaaggaggcgccggttctatttctgtgggaaggcagttctgctaacagtccctgagagcaagggcccagcagaggaggaattccaggggatgtcggtgtcactgaggtgaggctgcctggggccaagatgcagtgaggacttacaagcagagatggccttggcagaactggggttcaccctggggccttaccacaggcacctgtgctgtctttccagcccccaggacacagtcacactgcttgttaggaattgttcacccatggggcagtgaccattgggaatgagattcatgcggctgtcttctggggcctgggggaccagagcttggaagagcttcaccacattgcttgggttcacagtccagccctcagtgcttgtcagtacagatgccctcaggcccctatttgctcacatactgcaggtcctgtagaaaacctctcctcctctcccccatccacttgcccttcctgcctgtctatgccatggtagtgggggaggggcccagctcccaggagccccacgctgacgccgtcaggaatattgggtttaatgagctgcaaaatgaggcggctgcagctgacatgtacggatggtgcccacacccgccttcccccaccctctcccagtgtttgcctcctagcaccccgtcacatccttctccagatactcagctctttctgtgggatgcacccctctctggtttcacacccattcccggcagtgccaggggtgccaagatcttgcatcccccatctgttttcacttaagctccacaggtggttaggaatgagaactgggagctcacactagtcttgcaggtttactctggcctccccctgcaagctgtcctggagtgtgtggccttgcagctggggaagggtctaggggaggacacttgccagtggagcagggtagtgagtggagttgtggcgatagcatgccctgggtgtgcacgcaggccaggagccctgatggcataaacacccccccaacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315601 - DNA, 351 bp, Homo sapiens
  misc_feature (120)..(120): n is a, c, g, or t
ccctggcctcctgaaagcctgtgtatgttatcaatactgtttcctccctgtgagtcccattatttctgaaaattggcagagtcaaaggaagaggaatcgtcctaagctggggctgtgggnaggaggataggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315602 - DNA, 523 bp, Homo sapiens
ggtccctgtcccgaggggcaggttgtggaggggcagtggtccaagcacctcttgtacaggttagggttcaagggaggcagccgggtaggccacacgctctagtgagggcagttgcggtgcagaccacctggttgtgccgtgcatgcttcccgagtcctggaggagctgccctactgtttcttctccattctgtgatctctgtctttttctctttctttcccttctctgttccacatccacaccttactctgattgggagtcatagctctgttctctctgccccagctgtcccggaatccctttccctgccatgggcatgctagaaacatgctgcagtgccctgggccacctccggctcccgcctcctggcctcctgcactctaaacatacatacctgaatgtgagagtttgtccggggtgaccctctacctccttccagaccacctgcaggtcaggactccagtctgttcactgccaggccctgcagctgattcccacctaccagcctgtgcctctgacttag

SEQ ID NO: 315603 - DNA, 3138 bp, Homo sapiens
gtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315604 - DNA, 4417 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315605 - DNA, 4183 bp, Homo sapiens
ggcctctaacctgggcctggtatttgggccacaggggcactaggccaggtgtggcttggtggggggacaataaacctgctggagcaggaagaggaggaaggacacagggccgaaaccagggggactgagcccacagccctcagagtcctgttctgaagaccatccttactctgcttcactcaagaagaaccttcccactgcctcctggggaactagggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315606 - DNA, 3349 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315607 - DNA, 3882 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315608 - DNA, 3886 bp, Homo sapiens
gcgccggagcccgcgctgggggctgccggggaccaggcccggccggacgctgcaggctcgctgcatggagaagaaggcagctcggccccacgcccggcgctggccagcggacgaggcccagagggcagggggagtccaagcccgcccggcacaatttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315609 - DNA, 2818 bp, Homo sapiens
gcgccggagcccgcgctgggggctgccggggaccaggcccggccggacgctgcaggctcgctgcatggagaagaaggcagctcggccccacgcccggcgctggccagcggacgaggcccagagggcagggggagtccaagcccgcccggcacaatttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315610 - DNA, 2964 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315611 - DNA, 5973 bp, Homo sapiens
  misc_feature (5370)..(5370): n is a, c, g, or t
  misc_feature (5398)..(5399): n is a, c, g, or t
  misc_feature (5402)..(5402): n is a, c, g, or t
  misc_feature (5412)..(5412): n is a, c, g, or t
  misc_feature (5415)..(5415): n is a, c, g, or t
  misc_feature (5423)..(5423): n is a, c, g, or t
  misc_feature (5435)..(5435): n is a, c, g, or t
  misc_feature (5439)..(5439): n is a, c, g, or t
  misc_feature (5472)..(5472): n is a, c, g, or t
  misc_feature (5497)..(5497): n is a, c, g, or t
  misc_feature (5502)..(5502): n is a, c, g, or t
  misc_feature (5513)..(5513): n is a, c, g, or t
  misc_feature (5517)..(5517): n is a, c, g, or t
  misc_feature (5527)..(5527): n is a, c, g, or t
  misc_feature (5531)..(5531): n is a, c, g, or t
  misc_feature (5533)..(5533): n is a, c, g, or t
  misc_feature (5540)..(5540): n is a, c, g, or t
  misc_feature (5543)..(5543): n is a, c, g, or t
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaaggttagggggacccagagggaaaccgggcacaggaggtgggcagtgggacttggggatagtaccctaaaagtaacacctattttttattttttgtattcagtggattaagcactttctagtagttgctaatcaaagtagttctacagcttcttttggtaatctagacctggtatcttagaaaagttcttctgataactgaaaccctttctgttgaaatgtgggcttacttcatttattcttaaggtaaaagacagcagactgctacatcaatagctcctctaagatgttcgggcaggacctgtgttttctgtctcttgtgtcatactgagtttaataaagtgctgggtacttactaggtgcgtaatacatgtgtacagattggctgagtctctcattagttttccttaggctaaggaattccaggtcctgaagccttcttccataggacctttctcttcctctattaattatactgctgctcctcagattttcctcaaagtatcttcaaaacctccctcttcttggtgattggagtttctttgctcccaaataagtttaacttctacagactcataatttctcacttctgctctaatcatcagggtagacgtatgggtcaggggagcagagacacctagccaacctgtgacacagtgatgcttagtacttacagcgtggggtctcccttctggtccggcagactaagccccacaaatgatcatggagatcacgtagttcgaaggctgtggttgaaagcaaggtgaggcgcagtggtggtgcctggggaaggaggcgccggttctatttctgtgggaaggcagttctgctaacagtccctgagagcaagggcccagcagaggaggaattccaggggatgtcggtgtcactgaggtgaggctgcctggggccaagatgcagtgaggacttacaagcagagatggccttggcagaactggggttcaccctggggccttaccacaggcacctgtgctgtctttccagcccccaggacacagtcacactgcttgttaggaattgttcacccatggggcagtgaccattgggaatgagattcatgcggctgtcttctggggcctgggggaccagagcttggaagagcttcaccacattgcttgggttcacagtccagccctcagtgcttgtcagtacagatgccctcaggcccctatttgctcacatactgcaggtcctgtagaaaacctctcctcctctcccccatccacttgcccttcctgcctgtctatgccatggtagtgggggaggggcccagctcccaggagccccacgctgacgccgtcaggaatattgggtttaatgagctgcaaaatgaggcggctgcagctgacatgtacggatggtgcccacacccgccttcccccaccctctcccagtgtttgcctcctagcaccccgtcacatccttctccagatactcagctctttctgtgggatgcacccctctctggtttcacacccattcccggcagtgccaggggtgccaagatcttgcatcccccatctgttttcacttaagctccacaggtggttaggaatgagaactgggagctcacactagtcttgcaggtttactctggcctccccctgcaagctgtcctggagtgtgtggccttgcagctggggaagggtctaggggaggacacttgccagtggagcagggtagtgagtggagttgtggcgatagcatgccctgggtgtgcacgcaggccaggagccctgatggcataaacacccccccaacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacaaaaaaaaanaaaaaacaaccctggagaaaactaaacnnaanacctaccccnaanaaaaaacnaaccaaaaacanaaanccctcaataaacaaaaccataaacataacctcnaaaaaaacccaaaaaaagaaaaaanggacnaaaaaaactcnaaanaccaaaaaanccananaaccctnaanaacaatgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315612 - DNA, 3433 bp, Homo sapiens
aggtggacgcttggcctgtgtctgcccagcaggtgccgctgccgcccgccgccgccgccgcctcctcctcctcctggtcctcctccttctcctcctcctccttgtccttctcctcttcctcgtccttctcctcctcctcctcctcctcttcatcccgctgccgccgctccccaggcgcctgggtctctgccctcaccggtgctgaccgacttgtgcggggcttgagtataacttgccaaaatctttattctttcgatatttgcagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315613 - DNA, 2580 bp, Homo sapiens
  misc_feature (23)..(23): n is a, c, g, or t
  misc_feature (49)..(49): n is a, c, g, or t
  misc_feature (66)..(66): n is a, c, g, or t
  misc_feature (81)..(81): n is a, c, g, or t
aaacagctatgacatgattacgnaatttaaataggactcactaataggnaatttgccctcgagccnaaaaaattcggcaanaaggcacagatctgaagcggtgcacctactatgagacgtgcgcgacctacgggctcaatgtggagcgtgtcttccaggacgtgggtataattgactctgctgtcccctgcagtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315614 - DNA, 2483 bp, Homo sapiens
  misc_feature (2471)..(2471): n is a, c, g, or t
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaggcagaggagtngccctgtcatcc

SEQ ID NO: 315615 - DNA, 2796 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagcagggagccagaggacagctgggctgtttccctagagcaagggaaacgagaagacgctgtcctgtcccgttcctgtccctgacatccctcacctgggagcggcagtggcatggaggagacagccccgtgccctcgctcctgtaatgacagcgcccacacgcaggagctcgcggacggtgcccacccagcccgcgtcccgctgccgcatgccgacgccgacaccgaccctcgtgcacactcacacatgtctctcactcaccgggcgatgttaacatctcattatctttgttactgtaattacattatccgctgctttatgcagaattatcctccgagga

SEQ ID NO: 315616 - DNA, 2535 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatcaagggtctcgcctgagccccaagggcatcgggactggtgactcacctatggatgggggccggggagacaggacacacagaagatgagttcgtgggccagccctgagccccgcgcccgattctcgccggcccaagagagcccgccgcagcctcccccattttgcagccagcggagccattcacacaatcaccttctgttaattctatctgcaacatcaattaaattgtttgtagaaactaattgaa

SEQ ID NO: 315617 - DNA, 318 bp, Homo sapiens
gttcggcctgtgccccgccctgcccttcctgtccccaccatgtctgtcttgcctctgtgcgtcctgccacttctgctggcctcctgctcacacctgtccaccttcctctggcctcccagccttgcatgttgcttggaaacattggttggaattccatttagccggcaccgtagccttggcctcatccctgccccacggtgcctgccccttcccgctgcaatccccacttctctctgctctccaccattccacagcctgcattccctaccccgatgccctctgctgaaagtcctgggccatccacaggtggcatggtca

SEQ ID NO: 315618 - DNA, 265 bp, Homo sapiens
cttgctggttgggactgggagaggtggtatgtccagggagaagggtctacttgagttcacctgccctgcatgggagtttgccaggtccagttgcgggtgctaattttacttgctctaccctagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcagg

SEQ ID NO: 315619 - DNA, 550 bp, Homo sapiens
gggaggagcatcactgatggccactatctacacccctgagcgtctactcctggccgtctatacccctgactgtctacacctccgatcatctacacccgacggtctacacccctgacaggcttctcctgtcgaggtggctccacacactggggagggaagacgcccacctgccggaacagcggtccagctgcttcctgatggatgatgggggagagccgagttctggggaaggactggtctaaggggccttcccaagttcaccgataggtccttaaaggctgctttgctcaaagtggcccaggagaagcggggaggggggagggcattgcctgacgacatcgtgacctcctcatgccctatgacctagggggctggctcctggtttctgatcagacctctgttctcaggggatcctgctaaagcggagcggcaagtccctgaacaaggagtggaagaagaagtatgtgacgctctgtgacaacgggctgctcacctatcaccccagcctgcatgtgagtctgggaggaggagcctcctgggggagtatggg

SEQ ID NO: 315620 - DNA, 3123 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315621 - DNA, 571 bp, Homo sapiens
tgtatatcgatgccactatcagaggaggcattttctgagtgcagcccactcacatgcaacaactcattcctgctcaacccatttatttctacacaaatggatattcgggactttcaaatagttcatccagctgagcgtggtggctcaggcctgtaatcccagcacttcgggaggccgaggcaggtggatcatctgaggtggggagtttgaggccagcctggccaacatggtgaaaccccgtttccactaaaaatacaaaaatgagcggggtgtgctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggcatcgataaacagcggtgtttatcgatgccactcaaagtaaagataagcaaaaaaagtatataaataaaaatccatcaaaagcacaaacagggtctggcacctgtatgagaagaagctatgaacatcgggtaccga

SEQ ID NO: 315622 - DNA, 4191 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315623 - DNA, 3425 bp, Homo sapiens
gtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtggaaaaaaaaaaaaaaacaaaagggggggggaaaaaaaattcccgaggggccaagttagggtaaccagattctggcacgagggggccccaaaaggaggacgcgaaaaagaccaaggcacggggccgcgcgataaccacgcggaccgggaaaaccggacagcgcggacacggggagagaacccatacccgggggggaccagtggcccacaccagcgagaataagggcagggcacataccgtcacgcaatcagggaacagcgcactcaccagaagtgcccgcagcaggatc

SEQ ID NO: 315624 - DNA, 4463 bp, Homo sapiens
gtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtgggtataattgactctgctgtcccctgcagtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315625 - DNA, 3050 bp, Homo sapiens
gtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315626 - DNA, 4237 bp, Homo sapiens
gtctgcggcgggcagttcggcggcgcggggcccggggccgggggcggcggcggcccctcgcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtgggtataattgactctgctgtcccctgcagtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315627 - DNA, 5521 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaaggttagggggacccagagggaaaccgggcacaggaggtgggcagtgggacttggggatagtaccctaaaagtaacacctattttttattttttgtattcagtggattaagcactttctagtagttgctaatcaaagtagttctacagcttcttttggtaatctagacctggtatcttagaaaagttcttctgataactgaaaccctttctgttgaaatgtgggcttacttcatttattcttaaggtaaaagacagcagactgctacatcaatagctcctctaagatgttcgggcaggacctgtgttttctgtctcttgtgtcatactgagtttaataaagtgctgggtacttactaggtgcgtaatacatgtgtacagattggctgagtctctcattagttttccttaggctaaggaattccaggtcctgaagccttcttccataggacctttctcttcctctattaattatactgctgctcctcagattttcctcaaagtatcttcaaaacctccctcttcttggtgattggagtttctttgctcccaaataagtttaacttctacagactcataatttctcacttctgctctaatcatcagggtagacgtatgggtcaggggagcagagacacctagccaacctgtgacacagtgatgcttagtacttacagcgtggggtctcccttctggtccggcagactaagccccacaaatgatcatggagatcacgtagttcgaaggctgtggttgaaagcaaggtgaggcgcagtggtggtgcctggggaaggaggcgccggttctatttctgtgggaaggcagttctgctaacagtccctgagagcaagggcccagcagaggaggaattccaggggatgtcggtgtcactgaggtgaggctgcctggggccaagatgcagtgaggacttacaagcagagatggccttggcagaactggggttcaccctggggccttaccacaggcacctgtgctgtctttccagcccccaggacacagtcacactgcttgttaggaattgttcacccatggggcagtgaccattgggaatgagattcatgcggctgtcttctggggcctgggggaccagagcttggaagagcttcaccacattgcttgggttcacagtccagccctcagtgcttgtcagtacagatgccctcaggcccctatttgctcacatactgcaggtcctgtagaaaacctctcctcctctcccccatccacttgcccttcctgcctgtctatgccatggtagtgggggaggggcccagctcccaggagccccacgctgacgccgtcaggaatattgggtttaatgagctgcaaaatgaggcggctgcagctgacatgtacggatggtgcccacacccgccttcccccaccctctcccagtgtttgcctcctagcaccccgtcacatccttctccagatactcagctctttctgtgggatgcacccctctctggtttcacacccattcccggcagtgccaggggtgccaagatcttgcatcccccatctgttttcacttaagctccacaggtggttaggaatgagaactgggagctcacactagtcttgcaggtttactctggcctccccctgcaagctgtcctggagtgtgtggccttgcagctggggaagggtctaggggaggacacttgccagtggagcagggtagtgagtggagttgtggcgatagcatgccctgggtgtgcacgcaggccaggagccctgatggcataaacacccccccaacagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315628 - DNA, 3612 bp, Homo sapiens
ggtccctgtcccgaggggcaggttgtggaggggcagtggtccaagcacctcttgtacaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcagatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacaggtgccccccactcggccagcagcgcatccctgcactctgagcgccccctcagcagctcggcctgggctggcccgcgccctgaggggctgcaccagcgctcctgctccgtttccagcgccgaccagtggagtgaggccaccacttccctgcccccaggcatgcagcaccctgccagtggcccagctgaggtactcagttccagccccaagctggatcctcccccatctccccactccaaccggaagaagcaccggaggaaaaagagcaccgggaccccccgaccagacggccccagcagtgctactgaagaggcagaggagtcgtttgaatttgtggtggtgtccctcactgggcagacgtggcacttcgaggcttcaacggcggaggagcgggagctgtgggttcagagtgtgcaggcccagatccttgccagcctgcaaggctgccgcagtgccaaggacaagactcgactggggaaccagaacgcagctctggctgtgcaggccgtccgcaccgtccgcggcaacagcttttgtatcgactgcgatgcacccaatccagactgggccagcctgaacctgggtgccctgatgtgcattgagtgctcaggcatccaccgacacctgggggctcacctgtcccgggtgcgctcccttgacctcgatgactggccgcctgagctgctggctgtcatgactgccatgggcaatgccctcgccaacagcgtctgggagggggccttgggtggctactccaagccagggcctgatgcctgcagagaggagaaggaacgctggatacgggccaagtatgaacagaagctcttcctggccccactgccaagctcagatgtgccactggggcagcagctgctccgggccgtggtggaagatgacctgcggctgttggtgatgctcctggcacatggctccaaagaggaggtgaatgagacctatggggacggggacgggcggacggctctacatctctccagtgccatggccaacgttgtcttcacgcagctgctcatctggtacggggtggacgtgaggagccgggacgcccggggcctgactccactggcatatgctcgccgggccggcagccaggagtgtgcagacatcttgatccagcatggctgccctggggagggctgtggcttagcgcctacccccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtgg

SEQ ID NO: 315629 - DNA, 2622 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggggatcctgctaaagcggagcggcaagtccctgaacaaggagtggaagaagaagtatgtgacgctctgtgacaacgggctgctcacctatcaccccagcctgcatgattacatgcagaacatccacggcaaggagattgacctgctgcggacaacggtgaaagtgccagggaagcgcctgccccgagccacacctgccacagccccgggcaccagcccccgtgccaacgggctgtccgtggagcggagtaacacacagctgggtgggggcacagaatggcagtaaagctgaggcgaagcaaatggcatatgtggactagaatggagggtgcaggggcccaagccaggaggggcccctcaaggagcactgcggcgatgggtgtcagcaccacccagctcgttccacaagttggaagatctctgatgcagagaccccccg

SEQ ID NO: 315630 - DNA, 1932 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgatatgtgccactgtttccaacttttcatcaacaaaaaggcctttccaactccttccaaattagaagaccagttggtgacacacagcacctctggacatgccccctgtgcggggccggaggcgggccgggccctgggactgctctcagatgagaagcggccgcgagctccccactccagagacccacgggaacctttgtaactaaccccacccccagggaaggctaggagcgccggagcccgcgctgggggctgccggggaccaggcccggccggacgctgcaggctcgctgcatggagaagaaggcagctcggccccacgcccggcgctggccagcgcgacgaggcccagaggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaa

SEQ ID NO: 315631 - DNA, 1304 bp, Homo sapiens
gccatgaacttccaggcgggcggggggcagagcccgcagcagcagcagcagctggccggcgggcccccccagcagttcgcgctctccaactccgcggccatccgggccgagatccagcgcttcgagtccgtgcatcccaatatctacgccatctacgacctgatcgagcgcatcgaggatttggcgctgcagaaccagatccgggagcacgtcatctccatcgaggactcgtttgtgaacagccaggagtggacgctgagccgctccgtaccggagcttaaagtgggcatagtggggaacctgtctagcgggaagtcagccctggtgcaccgctatctgacggggacctatgtccaggaggagtcccctgaaggggggcggtttaagaaggagattgtggtggatggccagagttacctgctgctgatccgagatgaaggaggcccccctgagctccagtttgctgcctgggtggatgcagtggtgtttgtgttcagcctggaggatgaaatcagtttccagacggtgtacaactacttcctgcgtctctgcagcttccgcaacgccagcgaggtgcccatggtgcttgtgggcacgcaggatgccatcagcgctgcgaatccccgggttatcgacgacagcagagcccgcaagctctccacagatctgaagcggtgcacctactatgagacgtgcgcgacctacgggctcaatgtggagcgtgtcttccaggacgtggcccagaaggtagtggccttgcgaaagaagcagcaactggccatcgggccctgcaagtcactgcccaactcgcccagccactcggccgtgtccgccgcctccatcccggccgtgcacatcaaccaggccacgaatggcggcggcagcgccttcagcgactactcgtcctcagtcccctccacccccagcatcagccagcgggagctgcgcatcgagaccatcgctgcctcctccacccccacacccatccgaaagcagtccaagcggcgctccaacatcttcacgctaatgaaccggcggccggaaggctgtttgcccaaggcgacacagagggttagctggcccagctagagtcagagcccaggcctccccgtcgccttccggctctttttccgttaccccactgccgaggggaaaattcatgctttccacccaccgctgtgattggtttaacaaaggcttagccatcttttcctgggcttcaccacgctgcctcgttcctccctctcaggtttgtcctgtctccttgtgagctcctcactcacccctcacaaacctcacacccc

SEQ ID NO: 315632 - DNA, 555 bp, Homo sapiens
gagggtgattaaggatcctggtattgagtggcatgtgacctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagagaccggatgtctgg

SEQ ID NO: 315633 - DNA, 328 bp, Homo sapiens
tcaggtggtgggggtagggtctccttccaggaccccaactcatggccttcacctccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315634 - DNA, 679 bp, Homo sapiens
gaggcgggggccagacttgggaatatgtgcagccctttctgggctggaaccagggtgcatgggttggggtagctgctgggaatatgcgacccctgtcttgctttgtgcagaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcccccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaat

SEQ ID NO: 315635 - DNA, 1029 bp, Homo sapiens
  misc_feature (35)..(35): n is a, c, g, or t
  misc_feature (43)..(43): n is a, c, g, or t
  misc_feature (45)..(45): n is a, c, g, or t
gggggggggatcctaacttaggctaggtagaggcngggtggtnanagccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315636 - DNA, 1386 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcccccttctggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaat

SEQ ID NO: 315637 - DNA, 1229 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggtgtgtgggcgctggggaaactgaggcacgtgggcaggggagcaggggacccagcctaccagcaggctctcaccctgctgccttgcaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315638 - DNA, 1085 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatttctacactggaaattttgctccatgagcagtaaaattcccctggaaactgcgccaaaggtggattttagcaaaaaaccggtt

SEQ ID NO: 315639 - DNA, 1084 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacagcccctctccaaaccccaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315640 - DNA, 1048 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315641 - DNA, 1113 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgaaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315642 - DNA, 993 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgcccaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315643 - DNA, 584 bp, Homo sapiens
ggagggtgggcagcactcgctttattgtccagcattccacatggataggccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaataaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315644 - DNA, 590 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggagatagaagagtgccccaggg

SEQ ID NO: 315645 - DNA, 325 bp, Homo sapiens
ggagggtgggcagcactcgctttattgtccagcattccacatggataggccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatccgacgtccaccgtgatccacatccgcagcgagaccttcgtgcccgaccatgtcgtctggtccct

SEQ ID NO: 315646 - DNA, 807 bp, Homo sapiens
gccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaaggtagggacggcgacagggcgggcaggctggagggaacaggcgccctgtcggggcacgcggctccttctttctccccagacttcacaggggaagaccagggccccgaggggacgctgtccctgccgggttcctggaaaaaccctgttcagttcccggcgctgcggccacactccctccgtgccgtttcgctttcgcatcccgcatctgagaggcgcagctgcctccacccgcctagtcccgcccaagggttcaatgagcgcctactgtgtacttttggggcaggagctggggtctccttttgtggcccagggcacaagttcagcagctggccaagggccgccggcatgcattcttgctgctacccttgatgcattcattccagccagggcagggctcgcgtgtctttgggacctattaggcagatgccctagaggctgagcgacttgctcaccgctccagcgacatgggccacccgccacccctcagctgaagccggaagtcagcacctattaggtgccgcctctattcagtcggacttggaaagggttcacgtggatcccttgctcagctcagaggcaaggtctccaggtgaagtgacaagaaatgagcatgggccaaggccggaggcggtggctcatgcctgtaatcccaa

SEQ ID NO: 315647 - DNA, 1031 bp, Homo sapiens
ggagggtgggcagcactcgctttattgtccagcattccacatggataggccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315648 - DNA, 1141 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315649 - DNA, 1825 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccaaaaaaaaaaaaaaaaaaaaaaaaaaaaaaaaaaaaaaaaaaaaaaaaagaaaaaaaaaaaaaaaaaaaaaaaaaagaagagggagggcggcgcgcgcagccaaaaagaaactccacccgcggcgggggcgcgccctagattccagcgcgcgcacgcacccgaggttgttttagcgagaaaagagggggcgcgccaactaagagagaggcgacgactatataataaacgcgagcgagagcgagcgcgcgcggcgccagcgggattaaaaacaacaccggccgccagagcgcggggggaaaacaaaaaagccgccgcacacgcggagaagcccaaccatgggtcggggaggaggaagcaaaccaccactacatcacgagcggggggggggggagcaaacaactacaatgtagtgggacgaccaaacacacatcccacctctcacgagagcagagaaatttataaaaggaccccgccaccaggcggaggcgggaagaaacaaatacaacacgtctgcaacgaggcgagcacaattagtcgaggcgggactacacaaccacacacacgccgcataaaacttagctacccggggggacgacgacaaaaacgaacagcgctgtgcctcacaccaacggagcagtaggatgtaacttaagcaagcaacagaatattatcacccgagcggg

SEQ ID NO: 315650 - DNA, 1086 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacagaacaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315651 - DNA, 1052 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgataatcctgctccactaagaatggtgctaaagtaaaactagtttaataagcc

SEQ ID NO: 315652 - DNA, 888 bp, Homo sapiens
ggtacaactggcagacaagggtaaggagctgggtctgatcttccaagggtttcccattgacggtgacccagggcacatactcgtgtggtggctggagagcatctgtccgctgggcgttggcgtgcatgagctgcatgccgcggtcccccattgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgcctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315653 - DNA, 1083 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315654 - DNA, 855 bp, Homo sapiens
tggcaggggtgggggtgggacactcagaggaaggagtggaggagggagagacgctggcccgggacccgaggggcgtgggcatcgggaggcgggcccgggttaggggcgggaccgccgcctggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgcctggtgccctacggaaacgcacaggaacaaaatgtcagtggcaggtgggagttcaagtgcagcatggagaagaggagtcaattccccaggggccggtaccgagcc

SEQ ID NO: 315655 - DNA, 401 bp, Homo sapiens
accaaggaggagatcgttgacaagtatgacttatttgttggcagccaggccacagattttggggaggccttaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315656 - DNA, 740 bp, Homo sapiens
ggtacaactggcagacaagggtaaggagctgggtctgatcttccaagggtttcccattgacggtgacccagggcacatactcgtgtggtggctggagagcatctgtccgctgggcgttggcgtgcatgagctgcatgccgcggtcccccattgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgcctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgcccaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagcc

SEQ ID NO: 315657 - DNA, 478 bp, Homo sapiens
actaccaagtggggttgagagaagtggggaactgcccagggctacacctgcctcccacgccttcctaatccacagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggtgtgtgggcgctggggaaactgaggcacgtgggcaggggagcaggggacccagcctaccagcaggctctcaccctgctgccttgcaggaacaaaatgtcagtggcaggtgggagttcaagtgccagcatggagaagaggagtgcaaattcaacaaggtggagatagaagagtgccccagggccccacactggggtgggggaaaactgtcccacgtacag

SEQ ID NO: 315658 - DNA, 1262 bp, Homo sapiens
  misc_feature (2)..(2): n is a, c, g, or t
  misc_feature (8)..(8): n is a, c, g, or t
  misc_feature (27)..(27): n is a, c, g, or t
  misc_feature (77)..(77): n is a, c, g, or t
  misc_feature (96)..(96): n is a, c, g, or t
cncagggnatcccccttggatttggcntgggttcctgatccccccatgagggtgccagaccaaaagaagggtgccgnttgacgccttgccggttgngtattcaacagcctccctcagtcgttacaggcccctccccctccagctgaagtatcttcaagagtatttaaagggccagcaccaattgcccccctctttcatttttctctttttccccttttgggagccagacattaaaagactaggaaattcaaaaacaactatggggaaaataagaaaatttagaaaattagacagtgactgcatgctcagggaaaggtacagctcaaaaaagatctggaaagaccttaaatttccatcttgggttgatcctctgcacagaaacagcctgcaacaatcaaaacaagaacaataaataaaaataacaaaaacagcaaacctagggcaaggggaggaagaatctaatttctagagttaccacattattagacttaacatgtccagtgttcagcaaaaaaaaaaaaaaaaaaaaaaaaagcctacaaagagacaggaaaatatggccatttaaagggaaaacaaaatcagcagaaactatccctaaaagaaaggccagatgatagatctactagacagagactctaaaacatctgccttaaagatgctgagaaaactaaaggaaaacctgcagaaagtcaagaaaatcatgcatgaacaaaatggcagtatcaatgaagagatagaaaacctataaagagaaacaaacaaaaaaaggaattgttgagcctgagaaacagaaaagaagattgaagaaaagtgaacggatcataaggggtatgtgggctaccaccaagcagaccaatatatctattgtgggagtcccagatggtgaagagagaaagaggcagagacaactttgaaaaaataatggctgaaaaattcccaggtttgatgaaacacacaaatataaacatctaaagaagctcaataaactccagatgatcaaactttcgaaaaccagaaaaagaatcttgaaaaccgcaagaggaaagctactcattacatgcaaggtgtattagtctatttttacactgctctagagatactacccaagactgggtaatttataaaggaaagaggtttaattgatgactcacagttccacataacaggggaggcctcaagaaacttaccatcacggtgaaggtgaagggtacctttgcacatggcggcaggagagagaagtgtgtgagagcccaggaaaa

SEQ ID NO: 315659 - DNA, 577 bp, Homo sapiens
gagaggatcctgggataatggcagagcaggaagctgtgtccccacctagaccacagttgcaccagaaggacctgtctgatgtaaccattttggaactctggaagctactgaaggcttgcaacttccaggggaggcttggatggcaaattggggttaattttggtttcagctcttggcacagcagcggctacccatgccccacagacagccatgcacatgttcttggagcacctcgcacacagcttgaggggttcagggtgagcaagaaggatccttttctccaaatagtgggtatctgtgctcaggatccctgattgctgcttctgatcacagaggtgcagacaaagaggtgcgctgcgctgccgttgttatcacacctccctcagtcgttacaggcccctccccctccagctgaagtatcttcaagagtatttaaagggccagcaccaattgcccccctctttcatttttctctttttccccttttgggagccagacattaaaagactaggaaattcaaaaacaactatggggaaaataagaaaatttagaaaattagacagtgactgcatgctca

SEQ ID NO: 315660 - DNA, 4183 bp, Homo sapiens
  misc_feature (8)..(8): n is a, c, g, or t
  misc_feature (4178)..(4180): n is a, c, g, or t
  misc_feature (4182)..(4183): n is a, c, g, or t
tccggccncagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcacaannnann

SEQ ID NO: 315661 - DNA, 413 bp, Homo sapiens
ctggcctgtgaggtatccattagtctttggtggatttagtcattgtgagtctgtagatcaccagtgagtgtcttgctaaagttcaggtctgggccagagaaggacgtggttagtttatcaggaccacgccaacttactgcccctttgggggctggtgatcagccttccctggcagtcctttctccatgcgccaccttcttcctgccttttgctcttagagccaggtctttagagcctcctttcccctgcagctggagaatagagggtgtctgcctgggggcctcgctacctgctgagaatcctgaatggggcctcttttccatcctgacaccttccttccccatccaggcagctactgggtcagtgacaagaggctgcccccctgctcactcagccaggccctcacctacttc

SEQ ID NO: 315662 - DNA, 539 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctgtgagtgaggccgggccggcggtgcaggacgccgggaccgggctggggcggaagccgaagccgggccgccgcgccggggctgccgtgccggggccgcgggcagggcgtccggatcgccctcctgagcggcagttcgcccccgagggcggtcgtcaggggtggacgtcgcaggcttttccggcgtcccctcggaacttgcacccctccaccgtaaattcccgggcttgctcttaaattttaattttgagcgttcctcaggtcggtgcctccgcttgcttc

SEQ ID NO: 315663 - DNA, 4576 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctggcaacaacttatatcgaggtaatattttgattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatga

SEQ ID NO: 315664 - DNA, 4880 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctggcaacaacttatatcgaggtaatattttgattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatgaaggcgttgtgtttctaatgtgaccaaaccatggggattctttgtcattaataccgtcctcctttgtaagtgctgttttttttttttcattcttgagctcctaatgacattagatcttatcaggggcagttggacagttcagtaaaggtaaatgctgctcttgctctagttgctgtgacctatgttctttctgacttgctaagagagccaagtgatagtggctagtgataagattgatacataaattgctttactttgaaataacactggaaaaccctaccgtagacctgatcaagaaaaaaaaa

SEQ ID NO: 315665 - DNA, 4508 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctggcaacaacttatatcgaggtaatattttgattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttcttttggggggggaagggggggggagtacttaaaatttttccgaagagggtggcaataaaagagctggggggggggaaaattttggtatccacaagggggggaaaggggaattgggggagaag

SEQ ID NO: 315666 - DNA, 427 bp, Homo sapiens
ttctttctctttaagaagttacgtgaattgtgtatgttctgttggaaggatggtaaaacttttatctttattcctagaaaaaatgtagaagatttcactggacctagagaaagaagtgatctgggatttatcacatttgatataactgctgatatcctttaagaaaatatttcgttgcgttttctgtagttttataatgagatatgtgttgtttaatgatttgggatacagtgtgactatctcattgaatcagccaaaccttggaaattccgcctttttcatcagtaaaataatgttaatacctccccatgacacttggagaaaacttcatagattcatgagtagttgtgtgaacatactttaaattcttaaccgaaacattaaattgattgaaaactacataagaaagtttgaatctgtattttag

SEQ ID NO: 315667 - DNA, 679 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaac

SEQ ID NO: 315668 - DNA, 4459 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctggcaacaacttatatcgaggtaatattttgattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagcagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatga

SEQ ID NO: 315669 - DNA, 3858 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctggcaacaacttatatcgaggtaatattttgattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacttgaattacagttatttgacaagcccacagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatga

SEQ ID NO: 315670 - DNA, 3830 bp, Homo sapiens
gcgcgcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggttttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctggcaacaacttatatcgaggtaatattttgattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcattatacttctgtgatgagtggatctgttagtctggtagagattaatgttgaaatttacagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatga

SEQ ID NO: 315671 - DNA, 2195 bp, Homo sapiens
cctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcacagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaagtaaattaaaagtcttattcaaaccaaatatgaaact

SEQ ID NO: 315672 - DNA, 2312 bp, Homo sapiens
cctttcgttgtgtcctgcattaatctggccgtgccatgcatctactccatgttcaggcttgtggagaggtacgagatgccacggcacgaagtctacgttctcctgatccgcaggggattgatgtagttctcaagtatgggatgtacagatgggcaggcagtgcacgcacaaaggctcctgggctgaggacgggactgaaatcatccagcgttccccttagtcaagctaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcacagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaagtaaattaaaagtcttattcaaaccaaatatgaaact

SEQ ID NO: 315673 - DNA, 2178 bp, Homo sapiens
cctttcgttgtgtcctgcattaatctggccgtgccatgcatctactccatgttcaggcttgtggagaggtacgagatgccacggcacgaagtctacgttctcctgatccgcaggggattgatgtagttctcaagtatgggatgtacagatgggcaggcagtgcacgcacaaaggctcctgggctgaggacgggactgaaatcatccagcgttccccttagtcaagctaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcacagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaagtaaattaaaagtcttattcaaaccaaatatgaaact

SEQ ID NO: 315674 - DNA, 1589 bp, Homo sapiens
cctttcgttgtgtcctgcattaatctggccgtgccatgcatctactccatgttcaggcttgtggagaggtacgagatgccacggcacgaagtctacgttctcctgatccgcaggggattgatgtagttctcaagtatgggatgtacagatgggcaggcagtgcacgcacaaaggctcctgggctgaggacgggactgaaatcatccagcgttccccttagtcaagctaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactcca

SEQ ID NO: 315675 - DNA, 1405 bp, Homo sapiens
ccattggtgtgtttgttgttgttactgtttttgtttgttttcaatgtagacaatacagctttggaaggggaagtctcatacaggttataggtctttctctctctagatttcaagaagcaggaactggccagttcctgcttcttgaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcacagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaagtaaattaaaagtcttattcaaaccaaatatgaaact

SEQ ID NO: 315676 - DNA, 1302 bp, Homo sapiens
gcatgagaagctatggaatcttgaaggcaagctggtctttcccttgtagagatggggcagagtgtgcctgcgttaacttctctttcctgtgtcaaacctagacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcacagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaagtaaattaaaagtcttattcaaaccaaatatgaaact

SEQ ID NO: 315677 - DNA, 604 bp, Homo sapiens
cctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggaggtaaatatttgccattcttaagtaattagggcctgatgctgtaaacagaacctgattcctggctgagtgggacatacaggtgcctgacatactcaaagcgtgcgttgttccaagtctgcctgttgtccttggggatactgttcacttctaaattagctaaaatttcaccttaacctgacagttctgttgtcatagttcactcggttcagttgaccttttacaaccttttgaaaacaaattctaaaaataaaagacagaaactgagccatttgaaatcttatccagccgagggcagtggctcacgcctgtaatcccaa

SEQ ID NO: 315678 - DNA, 480 bp, Homo sapiens
tagagccaggaacagaggagaattgagctgaggccacagccccttcccacatcctgactcttgtttgccttccagtgttgggaaaccctcattggccaggacatctaccggctccttctgatggattttgtgttctctttagtcaattccttcctgggggagtttctgaggaggtaaatatttgccattcttaagtaattagggcctgatgctgtaaacagaacctgattcctggctgagtgggacatacaggtgcctgacatactcaaagcgtgcgttgttccaagtctgcctgttgtccttggggatactgttcacttctaaattagctaaaatttcaccttaacctgacagttctgttgtcatagttcactcggttcagttgaccttttacaaccttttgaaaacaaattctaaaaataaaagacagaaactgagccatttgaaatcttatccagccgagggcagtggctcacgcct

SEQ ID NO: 315679 - DNA, 1846 bp, Homo sapiens
ccagcctctgactctctaacttccaccgctacaggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagatgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaaatgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcacagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaagtaaattaaaagtcttattcaaaccaaatatgaaact

SEQ ID NO: 315680 - DNA, 1442 bp, Homo sapiens
cctttcgttgtgtcctgcattaatctggccgtgccatgcatctactccatgttcaggcttgtggagaggtacgagatgccacggcacgaagtctacgttctcctgatccgcaggggattgatgtagttctcaagtatgggatgtacagatgggcaggcagtgcacgcacaaaggctcctgggctgaggacgggactgaaatcatccagcgttccccttagtcaagctaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttggtgagtaattaaactgggacagaataagacactaatttatttctggtgaaatatcctaagacaagtgtaagaattgctcatgtgtccattactttttcagttgcaaattggatccaaactggcttaaacaaaattccaagaataattcttgctttaggccttgcctaacgcaggaactcacagtgtcaccagaacccggtttctttcagttccgttcttacccatgttagttccttttgcaatagactctgcctaataagtgcaagacagctttatcaacttcttatatcttctcagagtcagtctggtgggaaagactgagggacccagg

SEQ ID NO: 315681 - DNA, 1632 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315682 - DNA, 456 bp, Homo sapiens
  misc_feature (17)..(17): n is a, c, g, or t
  misc_feature (50)..(50): n is a, c, g, or t
gagacggggcggatggnggggggtgtggggggatatgggggatatacttnggtagtcaaacggggcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315683 - DNA, 858 bp, Homo sapiens
tttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacggtaagagccaatgggctaccaacatttagtaacgtgtgatggttcac

SEQ ID NO: 315684 - DNA, 479 bp, Homo sapiens
aaggggtttaaactgacatttattaaaaagaatggttccttggaaaaaacatcagaaccatccctaaagatacagtcactctgataaagtaaacagagtcccagttatgctctgtgtaacaaataacagaacttgaacatgacatttatctgttccttaaacttacagaagctggctctgaagatattgacatacttcccaatggtctggctttttttagtgtgggtgagtgtcttcttccttccccaaattcagcagaggagatacaagggtatttgatgagggctgcagaacacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttt

SEQ ID NO: 315685 - DNA, 1647 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315686 - DNA, 1979 bp, Homo sapiens
tttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315687 - DNA, 1606 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315688 - DNA, 1703 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtgagtgtcttcttccttccccaaattcagcagaggagatacaagggtatttgatgagggctgcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315689 - DNA, 1561 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315690 - DNA, 1447 bp, Homo sapiens
  misc_feature (31)..(31): n is a, c, g, or t
gcggcgccccccccgaccgcctgtcgccccncgcacgtcccctccacccctcccctcccttcccgagcggtcctcatacgcgtctacttagtcctcacgccctcagcagaacaggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315691 - DNA, 1596 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315692 - DNA, 1578 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagacaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315693 - DNA, 1657 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaagattttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315694 - DNA, 1473 bp, Homo sapiens
  misc_feature (35)..(35): n is a, c, g, or t
gttaaggatcccctcacgcttatacttctcggagnggcttctggactcaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315695 - DNA, 1578 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgacggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315696 - DNA, 1579 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggatggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315697 - DNA, 1355 bp, Homo sapiens
accagccaatcaggctctctccagctctgtactgtggacagctctgtccttacgtataattgttaaaccctacatttcttgctgtcaaaaaacatgccctgatggcactaagttctttcttctcttatggtaatcctgccataattgctaaatgacctgtgttcagattacctggtaccatacaaaattgttctctggcaacaatattatagtatattgtatatgactatagtcgtgatttttagctcgtcttttcctcttaccaaaaccaacaggccttttgtttcctctcacatgctatttttctttttcagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315698 - DNA, 1550 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315699 - DNA, 1299 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaatccatggatgcacgtgagtagaccatgagtgaccatgacgacgtagcgtagagctcgagtacacgtctctcaaggataatcatattaattctctca

SEQ ID NO: 315700 - DNA, 1050 bp, Homo sapiens
  misc_feature (927)..(927): n is a, c, g, or t
  misc_feature (985)..(985): n is a, c, g, or t
  misc_feature (1042)..(1042): n is a, c, g, or t
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgaggctgggatacactgggtgggataattttatctattggatccctncctcgggggggacatctgggggtagggcttgtccatccctaatgggcccaggaggctnctttcgtggttattggaccccccgaaccattcccttccccttcgttcaaggggtttncttccccg

SEQ ID NO: 315701 - DNA, 1193 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatggccccttatagaatatcttcatttttcttcagttgtggtgctggccaaattctttactttgctttctttgtcaatgtgaaaatagttttcttgacatttatggtatattatacatataatatatagatacactatatatataattatatatgttttgtatatatatttacatatacttagtcacatgtatttatatgcaaatacaataccatatttaagtaaactatataatacagtaatatatatgtatttatatataatatataaagtttggaatacatcattgtcaaatttaattttataaatataaattttaaagtgtgatcatactgatgcatacatattgaagtatcaggtatttccttttaaataaatgtattatttttattggctata

SEQ ID NO: 315702 - DNA, 887 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaaggtacttcctcattttgttccttctctaatttatccccagcatttgcaaacaatccctatggtgggttgtcctgtcatcttttataagcgctaatgtatatattagctaatatgtaagagctaaagagcttatatttccttatttataaatgtgtgtgtatagtttccttataaaccagggcaagcatggcatatgaaagttgatgtcactcatactattcactgttctatgcggactcctttgagaaatgatgaagtgcccgactacagggtgatactcttcaggcccatcttgag

SEQ ID NO: 315703 - DNA, 686 bp, Homo sapiens
gaataaaaaaagtaaagatttaataaatttgttttgaaataaaataagttgaaatacgaaaaagacagaaaaggttttgaaagaggttttaaagaaaagtgcaggatattcattggtaaagatgttggtgagaggcttggaagcaaaacttcaggggaaaaagacaacatatggaattgaccacaattgaatttacaagtgaagtggctttacagaggaatcaggggatgtttctgagagaggaaattcattaaattctaacttgaatattttctgtttgcctttaagtcagagcaaaggctttgagtcccagcttcccagtttgtgaccttgagcaattgcttaacttttccaaagcctccaatagtcttcactaagctggctctgaagatattgacatacttcccaatggtctggctttttttagtgtgggtgagtgtcttcttccttccccaaattcagcagaggagatacaagggtatttgatgagggctgcagaacacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttt

SEQ ID NO: 315704 - DNA, 355 bp, Homo sapiens
gttttatttgttgagttattggctttttttttttaataacccacatcagtatatagaactttgcaataggcatttttgttttaacttcatttctggtgcagttttattttcctacccttgtctttctattttctctttcatctgctttagacttaaactgtgttttatgtattgctgtaagcctctttaaaccctttctaaaacaaagcagggaatacataaacaaatagttttttgttttttgtttttttttctttgtaacaaaatcgacttaaagcctccagagaagtagaatctgtagaccttccacactgccacctgattaaaggaattggtatgtatatgaaaatgcttg

SEQ ID NO: 315705 - DNA, 476 bp, Homo sapiens
gattggagaaagtactttaatttaaacattaaaaagattggtaactgctattttcaacagcatgtccccttaatcagtgtgtcattgtggaaaacagggcttattgatgattgagtgacatgcatgtacggtggtcttatattcatactttgtatcccctgaataggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttctt

SEQ ID NO: 315706 - DNA, 761 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgtcagagcaaaggctttgagtcccagcttcccagtttgtgaccttgagcaattgcttaacttttccaaagcctccaatagtcttcactctaaaataaaagataatcatatgagatattgtatgcagggtatttacaaggagcctggtacttggtgtacctaatgtatgttagttattattattaaattagaggagcaaaaatttctctagcattgactgctcctgacataatcacaccgaagaggggatacacgatgataaaaccttcctgcagtagtggctatagaaatgatgacggggagaagatctggaaaatattccaaagaaggctacagatagatacattttttccattggaattaggcaatggagttaaacagaagttacaatatggttgaaataaatgtatttttttaaaaaaagatttctctttccttaattattaaaaaatatacaattttgtagaaaattttaaacaaagtataaagaaaaaaataaaaatcattcataatcctatcaa

SEQ ID NO: 315707 - DNA, 610 bp, Homo sapiens
taaagtagaaacagattatgcatgaattctgtatatggagtaggaaacactttcttaaaggtcagggagccaatgatcagaaataacaccagacggacagcaataggaaagacagagaatgatctgttaggtcgtctaacagcttatacattcaacctttccttgcctgtggtatttaaatgtcagtgcctgcccagaggtcccgtagttatgtcttgtaaattaactctgttctttcaattctttagtaaatttgaagaagcagaaaattctctgttgcatctgaaaacagtcaaacatgagcttcttccaaggtacttcctcattttgttccttctctaatttatccccagcatttgcaaacaatccctatggtgggttgtcctgtcatcttttataagcgctaatgtatatattagctaatatgtaagagctaaagagcttatatttccttatttataaatgtgtgtgtatagtttccttataaaccagggcaagcatggcatatgaaagttgatgtcactcatactattcactgttctatgcggactcctttgagaaatgatgaagtgcccgactacagggtgatactcttcaggcccatcttgag

SEQ ID NO: 315708 - DNA, 2508 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatcccagttttgtctgtgtttaattctgaaggcatatggctaggagaaatgggaaagcagctgcttccttatggagtttggataggcaagcatggccatattaatttctcttgtggaaagctgaaagtgaatggactcttaatttgaaacaacaacaacaaaaatcaatgaaatattgcaactcaaattcccagttcctaaggaggtttccatcagctctcttccttaatgggagtccactttagagacaaagaggaaataagggttgggacaggaaggtcttgccacctcctcattgaacagaactgtgaactaaagccaggagaatgaagtcagtcgtccgtgaccacatggttaagcagcagcaatgctaggatcagggccgcgtgcccagctcacagagggagagtttttctgctcactgtacctcctataaaatcatcataagccctagagagagactttcatgtgtttctttccattgtaatttatcaaaccactttacttcacttctcatactttttccctatcatcatcatgaaaatatttgtcagttaattacaatatgccaaacaatgcaatgaaagtattacattcgttatcttatttaatcctaattgcagcctggagtaagtattgatattatatcactgttaacatttcacagatattcagtctatttctgatgccagagcctgtaccgctaaccactacatgatgctactgccatagaacgaactagtattttattactgtttttcctgatgtatacagtttcttcatgttttgtagatatgtttgagttctgcttttagatgaatcatttaatggattttaaatttaaatttcagtagtattcttaaatttggcctgtatccatt

SEQ ID NO: 315709 - DNA, 1890 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatcccaaaaaaaaaaaaaaaaaaaaaaaaaaaaaaaaaaaaaaaaaaaaaaaaaaacaaaaaacaacaaagaaaaacaacaaagacaaaagaagaaaaaaaaaaaagaaaaagacacaataaaaaaaaagacacacaccacagaacaacgaacaagacaagacaagctagcacgaccgcacagcagcacccacgcgagcaccaagccgccggacccaggccaccaccgcacatccagacaccgccccgccaccgccgaccggg

SEQ ID NO: 315710 - DNA, 1677 bp, Homo sapiens
agcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcagaaatcgacttaaagcctccagagaagtagaatctgtagaccttccacactgccacctgattaaaggaattgaagctggctctgaagatattgacatacttcccaatggtctggctttttttagtgtgggtgagtgtcttcttccttccccaaattcagcagaggagatacaagggtatttgatgagggctgcagaacactttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315711 - DNA, 1810 bp, Homo sapiens
gaataaaaaaagtaaagatttaataaatttgttttgaaataaaataagttgaaatacgaaaaagacagaaaaggttttgaaagaggttttaaagaaaagtgcaggatattcattggtaaagatgttggtgagaggcttggaagcaaaacttcaggggaaaaagacaacatatggaattgaccacaattgaatttacaagtgaagtggctttacagaggaatcaggggatgtttctgagagaggaaattcattaaattctaacttgaatattttctgtttgcctttaagtcagagcaaaggctttgagtcccagcttcccagtttgtgaccttgagcaattgcttaacttttccaaagcctccaatagtcttcactaagctggctctgaagatattgacatacttcccaatggtctggctttttttagtgtgggtgagtgtcttcttccttccccaaattcagcagaggagatacaagggtatttgatgagggctgcagaacactttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataataacgtattttgatgttttgtacttacatctttgtttaccattaaaaagttggagttatattaaagactaactaaaatccc

SEQ ID NO: 315712 - DNA, 684 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactgtaaggccatgtaacatccctgtaatctctggggacaggcatgcttcttgaatttgcacacaaaagctaattttatatgatttttcctaaccctggatgatttttatattaactaagattagttaatattgggcaa

SEQ ID NO: 315713 - DNA, 3058 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtctt

SEQ ID NO: 315714 - DNA, 2985 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtctt

SEQ ID NO: 315715 - DNA, 3559 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaaatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtcttaaaatcttgatttaacaattttggaattgaagtgttcataagttaaatgaactgtgcaatgaaggctgttagattatatagaaagaagggtaggcaacatgagtggaacacgttacaacataggatctgtactaattcttactatgtcaaataataaatgctctcattaggtaccagtatttttttggtctttatattaagagaaggagtaagcagaaaaacttaaagaaaactgctttgggccatctgttctttattaaataagtaaaatagataaaatgagagtatattttcatttgaaataaaatgactggactaagacagtccttctaattgtaactctctgtgtttgacaggtgaggtaatgtattagaaagaatgcaggcttaggtgaatggtatacctgaatctgaatccatgctctcccctgctagctttgtgggcctggagcaagtaacttaatttcttgagctgcaactgcaaaatgggaatcatatcaattttactgtagtgtagtttggaacaaaccattaaatgggcaaatggcccagtccagtgtatcatgtggagtgggtgttcaagaacattatgatggcaagcactttcttagcttgccatcctttgtaggatgagtttggcctttgaataaatgattaaagagc

SEQ ID NO: 315716 - DNA, 1030 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaagggtaaaacacaaacaaacaaacaaaa

SEQ ID NO: 315717 - DNA, 1708 bp, Homo sapiens
caagttgtgtgcaggtgctgagtggcctccctcgcaggctgggactgggcctctggagcagaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtcttaaaatcttgatttaacaattttggaattgaagtgttcataagttaaatgaactgtgcaatgaaggctgttagattatatagaaagaagggtaggcaacatgagtggaacacgttacaacataggatctgtactaattcttactatgtcaaataataaatgctctcattaggtaccagtatttttttggtctttatattaagagaaggagtaagcagaaaaacttaaagaaaactgctttgggccatctgttctttattaaataagtaaaatagataaaatgagagtatattttcatttgaaataaaatgactggactaagacagtccttctaattgtaactctctgtgtttgacaggtgaggtaatgtattagaaagaatgcaggcttaggtgaatggtatacctgaatctgaatccatgctctcccctgctagctttgtgggcctggagcaagtaacttaatttcttgagctgcaactgcaaaatgggaatcatatcaattttactgtagtgtagtttggaacaaaccattaaatgggcaaatggcccagtccagtgtatcatgtggagtgggtgttcaagaacattatgatggcaagcactttcttagcttgccatcctttgtaggatgagtttggcctttgaataaatgattaaagagc

SEQ ID NO: 315718 - DNA, 757 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactgtaaggccatgtaacatccctgtaatctctggggacaggcatgcttcttgaatttgcacacaaaagctaattttatatgatttttcctaaccctggatgatttttatattaactaagattagttaatattgggcaa

SEQ ID NO: 315719 - DNA, 801 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagacaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggagggtcagtattctttttatttaattttctggtcaggataatggtatcatttaccag

SEQ ID NO: 315720 - DNA, 3072 bp, Homo sapiens
agacgctggctgcggggcgaagtgggagggtggccgggcggggtgaggatgctgctgcgccctgccctggccgggaccgtggaggagcgggcactgccgtgggtgggggagccgctgtccgagcgggagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtctt

SEQ ID NO: 315721 - DNA, 3026 bp, Homo sapiens
gatcaacgtggcttcagtgaaataaaggagcaagaaatgttcaaaggaacaacatctttaccatctcatctcaagaatggaggggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggggaccaggggaagagacatgcgagggcctcatcatgccccagtagctcagacctgagcaggctgcaaaccaaagcagtcccaaaagctgacctgcaagaagaggacgcagaaatagaagtagacgaagtcttttggaatacaaggattgtaccgattttgcgtgaattagaaaaggaagaaaacattgaaacggtttgtgctgcttgcacacaacttcatcatgctttagaggaaggaaacatgcttggaaataaatttaagggaagaagtattctcctgaagaccctgtgtaaactagttgatgttggttcagactcgctcagccttaaacttgcaaaaataattctagcacttaaagtgagtagaaagaatcttcttaatgtctgcaaacttatatttaaaattagcaggaatgagaagaatgattctttgattcaaaatgacagcattctggaatcattattggaggtactaagaagtgaagacctgcaaactaacatggaagcttttttatactgtatggggtctataaagttcatttctggaaatctgggatttcttaatgaaatgatcagcaaaggtgctgtggaaatactgataaatttgataaaacaaataaatgagaacatcaagaaatgtggtacatttttgcctaattcgggccacttgctagtccaggtgactgctacattgagaaacttggttgattcatcattagtaagaagtaagttcctaaacatcagtgcccttccccagctctgcacggcaatggaacagtacaagggtgacaaggacgtctgtaccaatattgccagaatattcagcaaacttacttcttaccgtgactgctgcacagccttggccagctattccagatgttatgccttatttctgaatctaattaacaaataccagaagaagcaggatttagtcgtccgtgttgtttttattcttggcaacctgacggcaaaaaataaccaggctcgtgaacaattttccaaagagaaagggagcatccaaactctgctgtcattattccagacgttccatcagctggatctgcattcccagaagccggtgggccaacgaggcgagcagcacagggcgcagaggccgccgtcagaggcagaggacgtgctcatcaagctgactcgtgtgctggccaacattgccatccacccgggcgtgggcccggtgctggccgccaacccggggatagtgggcctgctcctgaccacgctggaatacaagtcacttgatgattgtgaggagctggtgatcaatgctacagcgacaatcaacaatttatcttactaccaagtgaagaattccataattcaagacaaaaagctatatattgctgaattgctcttaaagcttcttgtcagtaacaacatggatggaatcctggaggctgtgcgtgttttcggaaatctctcccaggaccatgatgtctgcgatttcattgtgcagaacaatgtccacaggttcatgatggcgctgctggatgctcagcatcaggatatctgcttttctgcctgtggtgttctcctcaatctcactgtggataaagacaagcgtgtcatcttgaaagaaggaggtggcattaaaaagttagtggactgtttaagagatttgggtcctactgattggcagctggcctgcttggtttgtaaaactttatggaacttcagtgaaaacatcactaatgcttcgtcatgttttggaaatgaagacaccaacacactcttactcttgctctcatcatttttagatgaagaactagcactggatggcagttttgatccagacctaaaaaactatcacaaactccattgggaaacagaattcaaacctgtggcacagcagcttctaaaccgaattcagagacatcacaccttcctggaacccctgcccattccctctttctaacatgatgcagattaacagtagaaacgagaactcacgtctccctcattcttaagaactggtaacaaacgtgaacatttttttcagcattaacaaatgtggaaagtttttcaagaactggttttagtgagtagctgaagtattttttaaaattaagcatttcttcttgttaggtattatggaaaaatgaatatacacattatatttcctgttgagagaaatgtaagatgaaaatatgtgcattttcaagtaaatgactttttcttctattctctattaaacaatttagttctagtctt

SEQ ID NO: 315722 - DNA, 1162 bp, Homo sapiens
cggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagatgctgtctccaaatgataaaatgttaggaaaactggatccattttatcaaccttcagtgtccaagcagaagaccagtgcagaaatcataagtgaagcaagaaatgcattaagaacagttagaacccaaagaccatttacaccacaggaggctcaaagaaaactattcggacctgcatcctcaagaacatcagaaaatagacctccttcctccttcagcctccatgcatccagttttgagtcatctgattccaggcctatctctggcacacgtcttagtccactagagctgaaaccgaaagttccagcatctcccaccagagaggaggattcctgcttttcctttcctaagcccccagtggaccctgcgaagattagaagagtaagcaacgccagggctcgcttattcagggctgcctcccagcgggcccttctgccggacagatcccttcctccctccgactcaaagaagacagtggaatccaaagaaacagttatgatgggggactctatggtgaaaataaatgggatttatttaacaaaatcaaatgctatttgccacttaaagagtcacccacttcagctaactgatgatggaggcttcagtgaaataaaggagcaagaaatgttcaaaggaacaacatctttaccatctcatctcaagaatggaggccctcactgtagattgtggaatgatgactaaggcttgaaagccttactaataaactatcgagtgctcttagtattgttggaatcaaaaataagaaaagagggcttctggttaaaggcacaaaggcattctccagtaatccaatgaaagcagcaaagaatgaaaaacagagaagtaaatttcatcaatgaaacaacaacaaaaaaatggctacgaccctgaactacacaacatgaagcaaactttacactgcagtataggcttgatttttgttggtctgtctagcaaacaggccttctcacattgtgtaataaatgctgctcagtccgtaaatg

SEQ ID NO: 315723 - DNA, 4305 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttacaaaattgtgtgccagtttctggg

SEQ ID NO: 315724 - DNA, 636 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccagtgaattgacatgtggacaattggccacccggacctcaatttgggtaccgagctcg

SEQ ID NO: 315725 - DNA, 4274 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagca

SEQ ID NO: 315726 - DNA, 4391 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggccccttcattcccccagcattccctggggcttgtgctgaccccggttgctggctcttggtgatgtctgcaggcaccagaggccatgcagtgggcctggagggggcttgatcatgaggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagca

SEQ ID NO: 315727 - DNA, 4358 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcaggtagccccccagccccgtgcacatggctgcagctcccactgagtgggtgaaaggggcagcgcctcaaggtccctgccattgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagca

SEQ ID NO: 315728 - DNA, 3672 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatctggggcagaggctgagccgggaggcccttgaggtgaggacacagcaggcccaggaccatggctggggaggatatgtcagcaccctgctctatgctgacccttgtcactgaaccctgatctagacttatatgaataaatgaaattacatgccaagggccctaaaaagcaaattttacaaaattgtgtgccagtttctggg

SEQ ID NO: 315729 - DNA, 3361 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctaccca

SEQ ID NO: 315730 - DNA, 1381 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtgggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggaggtacaggctgggatcctcattaagactccatcaccccctgaaacaggtcctgtgatcaacccctctcacacatggggagactgaggccccgagaaatacttgcttggggtcacaccacaaagggggtacagggccaagggccctcaccctgctggccaggctg

SEQ ID NO: 315731 - DNA, 900 bp, Homo sapiens
ctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagca

SEQ ID NO: 315732 - DNA, 404 bp, Homo sapiens
gaacatctccatcggggagatggtgcccagcaggcaggccttcgagtccatgctgcgctacatctactacggcgaggtcaacatgccgcccgaggactcgctgcatcctcactccccagtgaactcccaggtccccaccaaggggtcctggcacccacctcgggtggctttgaggcccgctctcctgccccagctaggtgatctgggcccagcgcctccctccagagggtttgctggtgcctggggctgggcctggtgctctctgaagcagttggcagctggcaaggaggggtttgcagccaggaggaaccagtgggttcctgaccctcacaactgcccagaggacggggtgggtcattgctttgtgtgacagttgagcacagacatggaggtactccttatgt

SEQ ID NO: 315733 - DNA, 883 bp, Homo sapiens
  misc_feature (509)..(509): n is a, c, g, or t
tgggggaggctccaaggacctgtgtgggtccaagctgggctctgctgcctcgtggaggtttgtgccatgccatcagctctttccacaggcccctggctgtgcctgcctggggcgctgggcccctggctctgtcctcacactggtttctcttcatggggttgatgatcaccttcaggaagcaaagctgatgaaggacaagggctcctcaccaaatagacactagtggtgcctgtttctgacttcttgctttgatgttctcttttagggtccagataatttttttttttagaaaagaaatgtagagtgaaggtgacagcctttgattatagtagtaaagatgatccaaatagtttgtataataaatacttggacacatgaatctgtatttgaaatttgaaaccatcctaataatatagccaaaaaaaaaaaaaaaaaaagagctctccgagggttccttcttccttccacgctttctccttggggctttgtgaagcagggaagaaagaagncctgtgcttgaagttcgcagtgaaggccgggttctctcctgtgcgaggaaggggaagttcacagcccgagaaggaagtttggggggcccatcggcggactacgccgtgccaccgaattgagaacccgagctcagtttttggagaaggcagaaaaaatttcttatccgtgagaacaaaccacgtgtcaaattgggtgtggctggggttgagcgttgcgggcctgcctggtgggttacatttccggcaaaccattgttggggaaagccacgttggattgagttacgaaccccgaggaaccacgttggcaggaatgcaaagcagtcacttcgcgcagctactggaactcctgaaacctccacttggacacatgttgg

SEQ ID NO: 315734 - DNA, 1884 bp, Homo sapiens
gcaccatagtatgctctgagtagctttacactgcctggtactgatagtagtggctcgatttttaagagccttcaattgtagatgaacatctctgttatttatccctcattcatccatccgttcattcattcagccttcaatcaacatctcttgagtgtctattatgtacaggacatgtactgagacaaaaaggaaacataagagctttttcactctaaaaatcttggcaataatgtcaacaccagaaagcctcctctggagaatcttacagagtgattgtagtttaatacaggaacacacagggctgtgtagcatgataccaggcccaggagatcagtaattacaaattaagggttaaatcagagattattcaacagagagggagaaaggaggagacagagggaggacctgttgtgttccagccattctggtattcctttatgtatctaatttcattcaaacctcacaacagtcttgtgaggcccttatataattactcccattttgcagatgaagtaactgaggcttagaaaggttaatagcaccggggaacaatttctctgggtgagaattgggactctgttgctggtcttctcagttcatttcctgaggtggatttactgagagaaggtgaaataaagccatatttagtataccagagaaggtagattttaagaatggtctcagtgttaatactgagaaaaagtcctgtcagttcagaaaaaatgtgaagtctactttagtattcctgtaatactaaaccgttgagtttctaaatatttatttattctaacaaaaagcaattactacaaatggatgacacatttaatgaacacaattttattttttttctgtaactgtgcttgttgaatgtcaatcatatttaaagggaatgactttgaagtaaaaccttttttcttgctactgaaaaaaatggagttgttttgggtggtaaagtgttaaggaatagggacagctggtcacacaaggaactcttgaaggccacatgtgaaaacctgtcacttgcacagaggccagtcccactaaggtgaccagagtgggctccaagcacaaactgccattggctatagatgggactgtgtccccccaaaattcatgtgttggagccttaaccctcaatgtgatggtatttgagatggggcctttggtaagggaagtttagatgaggtcacgagggtaggaccctcatgatgggatgagtccccttacaagacctctggcttgggccgggcgtggtggctcacacctgtaatcccaacactttgggaggccaaggcaggtagatcacttgatgccaggagttccagaccaggctggccgacatggtgaaaccccatctctactaaaaaatataaaaattagccgggctttgtggcatgtgcctgtaatcccagctattggcaggctgaggcatgagaatcgcttgaacccaggaggtggaggttacagtgagctgagagtgccccactgcactccagcctgggtgacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttccaaaaaaaaata

SEQ ID NO: 315735 - DNA, 469 bp, Homo sapiens
gaacagaccacattttgcttatccattcatccattgatggacatttgggttgacattagcatacaaaaatctgttttcttattttttttgagacagagcgagactttgtcccaaaacaaaataggtgaggggatagcgaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttccaaaaaaaaata

SEQ ID NO: 315736 - DNA, 540 bp, Homo sapiens
aggtgttcctggctctatgccaaatgcatcctggactggaaacctcagagctataaagtggagtgacatggaagacagacacggaggctgccacggccactatgtacatggtatttgtatctatggaaacggagacttaaagtggctggttaattcaccaagcctgtttgctaacaagtttgagcttaatacctacccccttactgtggaatgcactcagggtcagcagtggagtttaaaaattgtctcttttcaacttatttaaatgacagcacctgagaagaggaaccgttttacactggatgtttctcatgtagaacaagaaatctttctggaattgatgtttacatgtctgttgttggtcatctctcctgtgtcttaaatactttaatgttggaagagcatagtgtttgggctagtgggtttctgacagcccatgggaatgccctgaaactactgtatctgatgtttgttttcgatgaggttccatgttttgttttcttgggaataaattaatatattgttttccaaaaaaaaata

SEQ ID NO: 315737 - DNA, 302 bp, Homo sapiens
attgcaggtgttcctggctctatgccaaatgcatcctggactggaaacctcagagctataaagtggagtgacatggaagacagacacggaggctgccacggtgaggctctcgttccatgcttctaggccactgcctgttggtgttagcaggaaggtagctgtggaatccagggttctcatggagagagaattgctgctatatttagaccaatctgttagttattggagaagccagaggcttcaagacacagtccttcaaaaataagtttaaacatctcattgatgttctctaacttataatt

SEQ ID NO: 315738 - DNA, 119 bp, Homo sapiens
ggctgctgtaaaatattacaggcatactttggagatgttatgggtttggttccacatcactgcaataaaatggagcctcgctctgtcgccaagactggagttcagcggcacgatctcgg

SEQ ID NO: 315739 - DNA, 517 bp, Homo sapiens
gcagaaaagaaatgcaagttaaagatgagccaaatactaactgtgagggcactaagcagcggaatacacgcgcctgctggcctctgaagaatatcaaattatcccttctgtgtatgtttaaggtcaaatatctttattaaattgcagatgtctataagtagatatagattcttaaagctgtattgcaagagctattagtggtagtttattataattataataaatgtctcctgctgaagttcagagattaggactgtatctatcacttttgggtataatgatttaatcttgttcctacagtacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactgtgagtatttaattcaacagcagaggacatttgttggtctaactgtgtgtatctttacc

SEQ ID NO: 315740 - DNA, 455 bp, Homo sapiens
acggagcctttagattgctgaaaacagtcttatggaaggataacccattgtctgtcactggctggttgtaatgcaaggaagggacaaagatgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggtagagtgtctctttcccaaatactaacttcctcctgaaatgcctccacctccatcaaccatcaaccacctgtataaaattaatcgaatcatccctgcttccagctaacaaccacaatttctcatttttcaaacttcattctgttcatatcagatcatattgctaaagtaaacacttttaagaacagaaatgta

SEQ ID NO: 315741 - DNA, 6717 bp, Homo sapiens
acggagcctttagattgctgaaaacagtcttatggaaggataacccattgtctgtcactggctggttgtaatgcaaggaagggacaaagatgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 315742 - DNA, 6742 bp, Homo sapiens
acggagcctttagattgctgaaaacagtcttatggaaggataacccattgtctgtcactggctggttgtaatgcaaggaagggacaaagatgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaataaaaaaaagtcgacgcggccgcgaat

SEQ ID NO: 315743 - DNA, 6183 bp, Homo sapiens
acggagcctttagattgctgaaaacagtcttatggaaggataacccattgtctgtcactggctggttgtaatgcaaggaagggacaaagatgaaatggaaacatgttccttttttggtcatgatatcactcctcagcttatccccaaatcacctgtttctggcccagcttattccagaccctgaagatgtagagagggggaacgaccacgggacgccaatccccacctctgataacgatgacaattcgctgggctatacaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttatgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaacgggtcttatttttctgacttgagcatcttgttt

SEQ ID NO: 315744 - DNA, 6818 bp, Homo sapiens
cactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 315745 - DNA, 6614 bp, Homo sapiens
  misc_feature (1)..(1): n is a, c, g, or t
  misc_feature (24)..(24): n is a, c, g, or t
nggaatctccaggttcccccgcanatttccttccactcgggtggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 315746 - DNA, 6621 bp, Homo sapiens
cactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 315747 - DNA, 1740 bp, Homo sapiens
gaatatcagaagcagtacttgagatatgaagagagagataaaatgagaattaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggccctaaatttcttctggtagtgtcagttcaactttcagaagtgccacttaaggaagtttgatttttgtttttgtaatgcactgtttttaatctctctctcttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaata

SEQ ID NO: 315748 - DNA, 2005 bp, Homo sapiens
cactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccagtaagtaaactgggcgctctgtgtttggcagagggagtggcagagtggcgtcatttgtttgatcatggcaatgaaaagtcgaatttgtatctcaggccttacctgaggataaactctagctttgtatgtgaatacaatctactatttcggttttctgtatttctcatcctaacttgttattcaagctaaattggtatttacacacagttggttaacaatttgacttttgattgggagtgattttctgttggaaagttttattaaaattgttccatcccctcctttgttacctttaaagatattgaatagggaaccatgtgctgcctatagttcagctacttgagacactgaggcaagagaattgcttgagcccaggggttctgggctgtactgcaccatgtccattgggtgtccaaactaagtttggtgtcagtacggtgacctcctgagaatggggaaccaccaggttggcctaaggaggagtgaacaggatcaggtcagaaatggagcagatcaaaactcccatgctgatcagtagtgggatcatgccggtgaatagccaaaaaatacacacacacacacacacacacacacacacacacacacacactcactctctctcttatccatagctacatatgagaatttgtctataaataagatagtgtgggatttaaaaatttgtcttcattaagaaaaataccttcaactggcagtttaagttagggttttaaaccatttctaattcttagaaatatatttctattaaagctatatcaaaaaagtatatgtatatgccttatattttattttcttggctactgtggggtgcctttggaagaaaacaggtgtatgttatcctcaagtagttttatggttcagtttatttacactagcaccaaatacagctcatttgaaattaccctcaagaaggatttattgactaaccattaaactgttgtatctataggctagatttatattgcagttgaataagaattgggcttcttttattttctatctacattcaaggagtagccaaaatgattcatccccttgaaaggatcctgctgtatataatatgacaaaaattgagaattgcatagggattggagagacaaatgaaatttagataaaattcactttatatataattctctataaaactatataaataaccatgtatatatttatatatgatgtttttccaagataattgatatgttaatatatgttcaaaattttaattatataattagttttcatagtctccaaaattgtcttcaaaattcaactataacttaaataagcataaa

SEQ ID NO: 315749 - DNA, 606 bp, Homo sapiens
ggtatggtaccttgtttctttttttctgttgtacaagttatgaaatgtcaatttggctttgcttcatttattaaaatttatctcatatgtttccttgagaggaatggtctttttgttatgttgtgttttttcatgtttttgagtttaaaaagtacagtattccatgatcacgtctctgtatctacttcaccatccacaatcctaattcccgaactctttaaataggcctcttgacgatgcagccagctcagtgagtggctggtcatttgaaagtagcacattgtgtctcattttagtattctgaatcagtgcatcatataaatgcattttgaataatgcatgtctgctactttaattacttgtttaattatctttagtttgtttcaaagcctacaacaactgctgttgcttggatgattagaaaattgcttccagttgcagaaatctatttcctgttgtttcttctggcagtgattgcagatcggcctcccccagttattcgacaaggtcctgtgaatcagactgtagccgtggatggcactttcgtcctcagctgtgtggccacaggcagtccagtgcccaccattctgtggagaaaggatggag

SEQ ID NO: 315750 - DNA, 456 bp, Homo sapiens
ggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaaggcaagtatgatgaagcgtttgatttccatgcattgcagtatatttgttagaattttattagcttaatttaaattgttataatgttaatagtggcattaattactaactttcttgatattgaacatacattttgctaacagtatttgtttatttagaaaactagaaaagcaaaatgctataatagttgacttgcttcaatagtggcctacctcaaatgtgtaaatgtgaacattatattacttaatggcatatagaaatttaattattcagaactaaaattcacatttaaaaatgaaattgttt

SEQ ID NO: 315751 - DNA, 760 bp, Homo sapiens
tttattcttactctaaaattattctggctttacattcagtttaagtggttaagtgaaacagtttttagggtgcaaaaattattttcccactgtttttctcatgataatttgagtctcctgagctataatttctgaaggatttttactactttggcattatgtaatctgatctctgtcacaatgatattaaataagaactatctcactttcatatgtttgcttcataaaaggatatggaatgtacacatcagctctttttttttttttaaactagcatcaacctataacttggtataaacttcccaagtatttagagaatagtgctggtgaaaatttaaataggataggcatatagaaattatgacttgtattgagtgatgtcctttcaacctaggactagtgacaaccttcattttttcagagctgaagaaaaaaccgtgaatttaagatcatatttattggtgcatgtaagccattatcctgtcttaatgaaccgattaatgctgttgattgttgaaatgtgaaatgtagtcactgttgaccttgtaaatatctgccagagatgaaaaaatattttaagttattgtaaataaagatgtataaaattcagtatcagtctgcaatgcagaaacatatcttagatgttaaaatactgtgtttgagagatgtgtaatttacccttagatgtatctagttacattaagagtgtaaatttttttgtacagtataaaaatacagctctatttggcttttaactgga

SEQ ID NO: 315752 - DNA, 2790 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315753 - DNA, 1334 bp, Homo sapiens
attgtcagctcctgattctgcagaaaacacgaaactgagctgtacaaagatgctgatgaggggctgcagcatgcaattcacttcaccagcagtcactaaggtctgatctcttttctaaccatacctggaagatggaatgctggacccagggtatgcatagaaaatgggagttattagaaaagcagctttgcttgctttaacccaggaattgtatttctgacttttagacttggactgggactacaccatcaactttccttggtctccagcttgcagacaacagattatgggacttgccagtctccataatcagaaggctttgacatatcaatgcaccagggatcttaccaaactaaattttaagcacttatagctcaagattctccctctgagatgaaacatacttccaccctgtcatgtgtcagcttcagaagatatcaattgctcaagaaagtgttggacaagcagaaaagcacactgaacatttctggacttgtgaaagagctctgaatatggatctctcagggatattccatccccaccaatgctttaccaatgcgagagctggccaggctgagacatttaatgataacatggaacaatttattcaggaagatagtcaactactcatgtggctttatgattataaaacccactgaaaattgggtcccttgattctcttgatttttcctaagccttactccctaaagtctccaatttgatgaggtatttgatacttgatctctccttgaagtaaaatttggagcaaaatatattggactggaaggcctgagacctcgataagaagaaacatgaaccccagagccacaggtcaggaggttttcattataatactattgccctcttaaaacaaatactccaattgccaaggtttcctcacttaataatttatctcatatgtgtttttgaaagttactctgaatacttcttatatgtataaataagttagttaacagtaattaatgcagatatttaaataaatacaagcaggcaggtgggatgatgactacagtcacttgataaagaacagctaggtggccgggcgcggtggctcacacctgtaatcccagcattttgggaggctgaggcgggtggatcatgaggtcaagagttcgagactagcctggccaacatgatgaaaccccgcctgtactaaaaacacaaaaattagccgggcgtggtggcaggcgcctgtaatcccagctactcgggaagccgaggcagaattgcttgaaaccggaaggcggaggttgcagtgagccaagatcgggccactacactccagcctgggcgaaagagcaaaactccgtctc

SEQ ID NO: 315754 - DNA, 991 bp, Homo sapiens
attgtcagctcctgattctgcagaaaacacgaaactgagctgtacaaagatgctgatgaggggctgcagcatgcaattcacttcaccagcagtcactaagagtctcgctctgtagccaggctggagtgcagtggcacaatctcggctcactgcaaccttcacctcctgggttcaagaaattcacctgcctcagcctcccgaatagttgggactgcagaggaaaggccatgtgaagataaagaaaaggctgccatctccaggtcaggaagagaggtctcaccagaaaccaacttggacttctagcatctagaactatgtttattgtaaggattaaatcagctaaaccaagaaaagcctcagggatggtgcctggcaaactgcacgctgttaatacatgttagtggacccttctccacaccttcctgctacactaaagcagagagaattacctcctgaatcatgtttgcagaacttctgggcacagtgactcaactcccagctattcttgtcatggattttttctcttggagccaatccagccatggagatcactggtcttgtgacttattttttctctttcagtatgaaatcattagaactgagaaaatgaaaacattcctgttattacttcctgagagaaagaaacttagtaacatgctttggtaggaattgttcttctttttcctgctgtgtccctcttgctggtcccaccagggctcttggtcctgagcctgatttacaccaggagcataatctgatcaaaaagagggaaactaaagaaaaaaggcaggattgtatgaggggttctcacaatggcagtacataatcccttatacctcgtattatgtagacccctgtgtttccaagttacctttgtaatttaggtaagtgagcacgaaacacttaaaaaaacacaaatgaaaacaagagaaaggaaagagtggggaggggtttgtttatttttgaaaacaacgacaacaacatagagtaa

SEQ ID NO: 315755 - DNA, 2736 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagtagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315756 - DNA, 1616 bp, Homo sapiens
ccccccttcccgccgccccccccccctccccccaccctcctacacactcctccctctctcatccccacataccagccctggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315757 - DNA, 1078 bp, Homo sapiens
tcaacgctttatacttcgctgaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315758 - DNA, 1448 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttaaatgaaatagttttccggcgtcttcaaaaacaaattgcactgataaaaccatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315759 - DNA, 1537 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315760 - DNA, 787 bp, Homo sapiens
cgctcccacagggttcgacccgactcatgcaccccgcgtgccccccggcccagccagcccacccgaccttccagacacgcaggagccccagaagctcagctggtcctcactgcccagatgtgtacagctgctccccccttgcataaagcagcgccatgtgtgcagaggccactcttgaagagcagactccctctgtgactgatgggactaaatattcccactagccagcggactgaaggcaaagaagacctttctagaacctggttaggaaggaagctgtgcagcatgctcctcgtccatgtgtgtcggcagtgctggtgtctgtcgtctccgcgagctgttactggaatgagcccttgtgttcatgggtatcgtcattgcgggccttgtacgcgtacaaggccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315761 - DNA, 2566 bp, Homo sapiens
attgtcagctcctgattctgcagaaaacacgaaactgagctgtacaaagatgctgatgaggggctgcagcatgcaattcacttcaccagcagtcactaagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315762 - DNA, 2736 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccactattttttctgagattaatgtactcttggagcccgctactgtcgttattgatcacatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315763 - DNA, 2734 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgactggggaagcagtgccaagaattattttcattacaaccagagttatcctcccacatacaatgtgaaggacatgcttgtgccgactgcagtctggagcgggggtcacgactggcttgcagatgtctacgacgtcaatatcttactgactcagatcaccaacttggtgttccatgagagcattccggaatgggagcatcttgacttcatttggggcctggatgccccttggaggctttataataaaattattaatctaatgaggaaatatcagtgaaagctggacttgagctgtgtaccaccaagtcaatgattatgtcatgtgaaaatgtgtttgcttcatttctgtaaaacacttgtttttctttcccaggtcttttgtttttttatatccaagaaaatgataactttgaagatgcccagttcactctagtttcaattagaaacatactagctattttttctttaattagggctggaataggaagccagtgtctcaaccatagtattgtctctttaagtcttttaaatatcactgatgtgtaaaaaggtcattatatccattctgtttttaaaatttaaaatatattgactttttgcccttcataggacaaagtaatatatgtgttggaattttaaaattgtgttgtcattggtaaatctgtcactgacttaagcgaggtataaaagtacgcagttttcatgtccttgccttaaagagctctctagtctaacggtcttgtagttagagatctaaatgacattttatcatgttttcctgcagcaggtgcatagtcaaatccagaaatatcacagctgtgccagtaataaggatgctaacaattaattttatcaaacctaactgtgacagctgtgatttgacacgttttaattgctcaggttaaatgaaatagttttccggcgtcttcaaaaacaaattgcactgataaaacaaaaacaaaagtatgttttaaatgctttgaagactgatacactcaaccatctatattcatgagctctcaatttcatggcaggccatagttctacttatctgagaagcaaatccctgtggagactataccaatctgtgtgaagccaaagccccgtggttgcccatgagaagtgtccttgttcattttcacccaaatgaagtgtgaacgtgatgttttcggatgcaaactcagctcagggattcattttgtgtcttagttttatatgcatccttatttttaatacacctgcttcacgtccctatgttgggaagtccatatttgtctgcttttcttgcagcatcatttccttacaatactgtccggtggacaaaatgacaattgatatgtttttctgatataattactttagctgcactaacagtacaatgcttgttaatggttaatataggcagggcgaatactactttgtaacttttaaagtcttaaacttttcaataaaattgagtgagacttataggcccaaaaaaaaaaaa

SEQ ID NO: 315764 - DNA, 1305 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggttttatagcattttcacagatccctgagctggctaaaaggattaaaatgttttttgccctgggtcctgtggcttccgtcgccttctgtactagccctatggccaaattaggacgattaccagatcatctcattaaggacttatttggagacaaagaatttcttccccagagtgcgtttttgaagtggctgggtacccacgtttgcactcatgtcatactgaaggagctctgtggaaatctctgttttcttctgtgtggatttaatgagagaaatttaaatatgtctagagtggatgtatatacaacacattctcctgctggaacttctgtgcaaaacatgttacactggagccaggctgttaaattccaaaagtttcaagcctttgaattttttgcgactgtacacatagctgcagcattaagaacttaaaaaaattgtta

SEQ ID NO: 315765 - DNA, 929 bp, Homo sapiens
atgcgtaggcgacgcgctggtagagctgtggacctgccagcctgcgaggcggaggacgggctccatctcttagaaacgcctacggcgcatgctctatggggtcaactggggggctggcaagcggcagcgctggtctagggcggagtctccgaggcacttcccggtggctggctgctctgattggctgaacaaatagtccgagggtggtgggcatccgccctcccgacaaggcagaccaggccccctgcaggtcccctatccgcaccccggcccctgagagctggcactgcgactcgagacagcggcccggcaggacagctccagaatgaaaatgcggttcttggggttggtggtctgtttggttctctggaccctgcattctgaggggtctggagggaaactgacagctgtggatcctgaaacaaacatgaatgtgagtgaaattatctcttactggggattccctagtgaggaatacctagttgagacagaagatggatatattctgtgccttaaccgaattcctcatgggaggaagaaccattctgacaaaggtcccaaaccagttgtcttcctgcaacatggcttgctggcagattctagtaactgggtcacaaaccttgccaacagcagcctgggcttcattcttgctgatgctggttttgacgtgtggatgggcaacagcagaggaaatacctggtctcggaaacataagacactctcagtttctcaggatgaattctgggctttcagttatgatgagatggcaaaatatgacctaccagcttccattaacttcattctgaataaaactggccaagaacaagtgtattatgtgggtcattctcaaggcaccactataggcttatagcattttcacagatccctgagcttgctggattcctaggacgattccagatcatctattg

SEQ ID NO: 315766 - DNA, 1798 bp, Homo sapiens
aaaaagaaaaagaaaagaaaagaaaaggtacatcagacatgactgcctgcatgaagtcaaacagggtaacaccagtgaagctcaagtcaagagctgtggatattttgtctaaccaacaagaagtctcaagaaatcaggcagtgcagctgcctgcttctcagctatcgtatccagccaaaagatgcatgatgatggagtggtgggggaaggccagttcagtatcctatttaaaagtaaacttcctgaataatggatatatgtggagatacagacatagatatatagatacagctgtaattatttagcctcaagtgactttctccattgcttcacgctatgccactattttgcttctttaatttttttaaccttgcttagtattctatagtttgcccaaccagttttacgtccaaggaaaattagccaatgcataaaatatacaaactatgaaaggcaaggatcaggaaaccagagactttgccaccaaatctcagattattagaaactaggtgtcagggtttatcaagaaggccaggaaggccttttgggttaagccttacattcatgaagaacctcgagggtagatttttgagagcattccaaatgaatggtctctggtcaaatgaatgaatggtcaaatgaataaatctgccctcacagagatacaaaaggaaaaggaatataattcataccatttggtttaagccttacattcatgaagaacctcaagggtagatttttgagatcattccaaatgaagtcgaatctgccctcacagagacacaagaaaggaatataattcatacactattgcatttttaataaatcttttgaaatttgcagaattagattgtattgtgtattttcggttaaatgataattgaatgtaaatatttagatgcagcaccatattttataacccagctttagcatttcttcatattttaaggaaaccccccacctccttcttttaagggcgcttcttgctctctgaaatgccctgctaaatgcttctcttaattatttgaataaggtagtttggaataaagaaagaaaagatcactctacatacagatagtaaacttaatttgtgatcctatatatgagacagtataaaaatacagataagttttagaaagactcaaaacaatatgtaaatgactgatgtttgcattattaaggaaaacttgggatgttgggtcaagaggggaaagtgttagtcaatccactttggagcaatatcatgaaggtcaattataattccatatacctttctttgatgccacagtcagagatagaatacagtttgggtggccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgccaatactgttttgataaataaatagatttttaaaaataaatgtattgtacttattagtgtagt

SEQ ID NO: 315767 - DNA, 583 bp, Homo sapiens
ccttcatgatattgctccaaagtggattgactaacactttcccctcttgacccaatatcatgaaggtcaattataattccatatacctttctttgatgccacagtcagagatagaatacagtttgggtggccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgccaatactgttttgataaataaatagattttta

SEQ ID NO: 315768 - DNA, 1767 bp, Homo sapiens
aaaaagaaaaagaaaagaaaagaaaaggtacatcagacatgactgcctgcatgaagtcaaacagggtaacaccagtgaagctcaagtcaagagctgtggatattttgtctaaccaacaagaagtctcaagaaatcaggcagtgcagctgcctgcttctcagctatcgtatccagccaaaagatgcatgatgatggagtggtgggggaaggccagttcagtatcctatttaaaagtaaacttcctgaataatggatatatgtggagatacagacatagatatatagatacagctgtaattatttagcctcaagtgactttctccattgcttcacgctatgccactattttgcttctttaatttttttaaccttgcttagtattctatagtttgcccaaccagttttacgtccaaggaaaattagccaatgcataaaatatacaaactatgaaaggcaaggatcaggaaaccagagactttgccaccaaatctcagattattagaaactaggtgtcagggtttatcaagaaggccaggaaggccttttgggttaagccttacattcatgaagaacctcgagggtagatttttgagagcattccaaatgaatggtctctggtcaaatgaatgaatggtcaaatgaataaatctgccctcacagagatacaaaaggaaaaggaatataattcataccatttggtttaagccttacattcatgaagaacctcaagggtagatttttgagatcattccaaatgaagtcgaatctgccctcacagagacacaagaaaggaatataattcatacactattgcatttttaataaatcttttgaaatttgcagaattagattgtattgtgtattttcggttaaatgataattgaatgtaaatatttagatgcagcaccatattttataacccagctttagcatttcttcatattttaaggaaaccccccacctccttcttttaagggcgcttcttgctctctgaaatgccctgctaaatgcttctcttaattatttgaataaggtagtttggaataaagaaagaaaagatcactctacatacagatagtaaacttaatttgtgatcctatatatgagacagtataaaaatacagataagttttagaaagactcaaaacaatatgtaaatgactgatgtttgcattattaaggaaaacttgggatgttgggtcaagaggggaaagtgttagtcaatccactttggagcaatatcatgaaggtcaattataattccatatacctttctttgatgccacagtcagagatagaatacagtttgggtggccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgccaatactgttttgataaataaatagattttta

SEQ ID NO: 315769 - DNA, 2562 bp, Homo sapiens
tgcagctgttgaacgctgagtaacttctgcagagtcaggaagacccaaggaagctctgcagaggatgcaggggtacggtcagaacccctgagtgcctttcagctaacgaggactttatgacactccccagcacagcaaatttttatgatgtgtttaaagattgggtgaattactcaggtgaacaagctactttttatcagagaacacctaaaaacacgttcaagagggtttgggaactatacatttaatcctatgacaaactaagttggttctgtcttcacctgttttggtgaggttgtgtaagagttggtgtttgctcaggaagagatttaagcatgcttgcttacccagactcagagaagtctccctgttctgtcctagctagtgattcctgtgttgtgtgcattcgtcttttccagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgccagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaattctgttgattaaagatgagctttgtctacttcaaaagtttgtttgcttaccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataaaaaaaaaaa

SEQ ID NO: 315770 - DNA, 2266 bp, Homo sapiens
ggcgccacggcgggagacaggtgttgcggccccgcagcgcccgcgcgctcctctccccgactcggagcccctcggcggcgcccggcccaggacccgcctaggagcgcaggagccccagcgcagagaccccaacgccgagacccccgccccggccccgccgcgcttcctcccgacgcagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatctcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgccagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaattctgttgattaaagatgagctttgtctacttcaaaagtttgtttgcttaccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataaaaaaaaaaa

SEQ ID NO: 315771 - DNA, 992 bp, Homo sapiens
  misc_feature (10)..(10): n is a, c, g, or t
tcctgatccnatgcacaccgcttctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaattctgttgattaaagatgagctttgtctacttcaaaagtttgtttgcttaccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataaaaaaaaaaa

SEQ ID NO: 315772 - DNA, 2321 bp, Homo sapiens
ggcgccacggcgggagacaggtgttgcggccccgcagcgcccgcgcgctcctctccccgactcggagcccctcggcggcgcccggcccaggacccgcctaggagcgcaggagccccagcgcagagaccccaacgccgagacccccgccccggccccgccgcgcttcctcccgacgcagagcaaaccgcccagagtagaagatggattggggcacgctgcagacgatcctggggggtgtgaacaaacactccaccagcattggaaagatctggctcaccgtcctcttcatttttcgcattatgatcctcgttgtggctgcaaaggaggtgtggggagatgagcaggccgactttgtctgcaacaccctgcagccaggctgcaagaacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttctccatgcagcggctggtgaagtgcaacgcctggccttgtcccaacactgtggactgctttgtgtcccggcccacggagaagactgtcttcacagtgttcatgattgcagtgtctggaatttgcatcctgctgaatgtcactgaattgtgttatttgctaattagatattgttctgggaagtcaaaaaagccagtttaacgcattgcccagttgttagattaagaaatagacagcatgagagggatgaggcaacccgtgctcagctgtcaaggctcagtcgccagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtactttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcagaggctcagattgtaatatgtaaatggtatgtcattcgctactatgatttaatttgaaatatggtcttttggttatgaatactttgcagcacagctgagaggctgtctgttgtattcattgtggtcatagcacctaacaacattgtagcctcaatcgagtgagacagactagaagttcctagtgatggcttatgatagcaaatggcctcatgtcaaatatttagatgtaattttgtgtaagaaatacagactggatgtaccaccaactactacctgtaatgacaggcctgtccaacacatctcccttttccatgactgtggtagccagcatcggaaagaacgctgatttaaagaggtcgcttgggaattttattgacacagtaccatttaatggggaggacaaaatggggcaggggagggagaagtttctgtcgttaaaaacagatttggaaagactggactctaaattctgttgattaaagatgagctttgtctacttcaaaagtttgtttgcttaccccttcagcctccaattttttaagtgaaaatataactaataacatgtgaaaagaatagaagctaaggtttagataaatattgagcagatctataggaagattgaacctgaatattgccattatgcttgacatggtttccaaaaaatggtactccacatacttcagtgagggtaagtattttcctgttgtcaagaatagcattgtaaaagcattttgtaataataaagaatagctttaatgatatgcttgtaactaaaataattttgtaatgtatcaaatacatttaaaacattaaaatataatctctataataaaaaaaaaaa

SEQ ID NO: 315773 - DNA, 1346 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacga

SEQ ID NO: 315774 - DNA, 2490 bp, Homo sapiens
  misc_feature (1330)..(1330): n is a, c, g, or t
  misc_feature (1340)..(1340): n is a, c, g, or t
  misc_feature (1476)..(1476): n is a, c, g, or t
cattgaaactccactgaaaatgccatgggtggtttatggcaacttttacatgagtctagcaaaaggaaagaatgtgtcacctcttttctatcacaattgggggcttaagaatgcaggggtggatgtatcaacccccagaaagttacaagtttaagccaggaattctggccaggcaatcatttttagtaatacccttgagcttatgggagtggaagtttgtatttttttttttccaaagtacattactactaatgataatagttttcattagttctagtcactgggcttagcgttttccatattttaccctcatagcaacctatgaaacctgtgtaggaattgacatttgatgacaaggtctgttcaaatccagcacccatgtgttacttaccactctttataattttttaaaagagatttctccttctgaataccactatttttttttgaatggcagaataagaaaaattaaaatctgaaaagctcttagaaaatactgctacaatatctggaacctagtaatgctgcttcatgtagcctctccagactcttgcctgtggcttcccaaagactggcataaacaagaggaaaagaaaaatggacaaaatggggattactagtggtaatcttgactacttggtttgagcagagccctctaggatgtgtgggaggagcaggaaaggccagaggctgggaaggctgggccatgcacagttctgctagagaagaaaagctgtacattatatgagtagcatgagtctattctacttttaccttcagtctcattgggctaaacaaaaacttcatgggttggagaaaagcttatttatcttttctcagcatccagagaggcatgtgactgaaatgcagtcatggacagacgcgagactggaacctgagtgtacaattaccactgtggtgagatcagcaacattgtattcagacaggccatttacttacctgcagcctatggagtaaccagaatagactcttgcccttatgtgacccacttgttggaatgagtgtggatctttccatttatctatcacttcccatatgcatttttgtttttagtttttattatatgcaagcatatttattttatggaggttgagtaggaaacctaagctaaaggaagcctcagtgatatagttcaaaacttggaatggctctcccagtagctatagtcctcggtactgtatttcctgaaatccatgtctcatcccttcttgtaagtatggaacacacccagtggctcacgcctgtaatcccagcactttgggaggctgaggtgggcggatcacttgaggtcaggagttcgagaccagcntggccaacanggtgagaccccatctctaataaaaatataaaaattagccaggcatggtggtgtgtgcctgtagtcccagctactcaggaggttgaggcaggagaatctcttgaacccaggtggcagaggttgcagtgagccaagantgcgccactgcactccagcctgggtaacagggtgagactccgtctcaaaaaaaaaaaaagtatggaacacaccaacacttgtgatttcctctagggaatggaattcagaatgggagtcacctttggattttttgaaatatagttctgtattggtgagactgctttaacaacttgtatttcttctgtggttgtgctttggatgaatatagcccatccaaggtgacttctttacaaacactgaacaactttgggtggtagggaagtgggaactgcattactctctgatataataactaaccacaccattttcattttgctttgccagggtgagttctgcatcctggtacttcctcaatgtatttgggcttcggagcatttactctctgattctgggccaagataatggtaagaagcatgtcaggtttactaagcaaatacttccatagatgaatcatccatattagagccagaaaagtcttgtaggttgtgctgtttgttaccatagtcaaataaaatgtttccttccttaagtttctgaggtattctgaaagagtcttaaaaattccgggggtcaaactgaagatctcaattctctctggcaatgactgggacagtattttgattccccagagtctgataccatcatgtgagggatccagcaccagcagtgtaagcctgtgaacctaaagcttaaagaaggcttggtttgtcagttcattgactagagcccttgccagtactaatccttgctctcttgtttactggctgggacctcagaaaagttacttaacaagttacttaacttcgaattctctatttacttatctgtaaataaggactttattagttaacctgtggggttgttaggaacagatgaggaaaaatatgcaaagcacttagtgaagtacttggcatgcagtagttgctcaataactggtggctgttattgttgaaatttgaaataaagtttagagcttcctttagtgatctctcttttgctgttactgtccccat

SEQ ID NO: 315775 - DNA, 831 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagtgtggagagagctccacactggccatctgatctataaatgcggtggcatcgacaaaagaaccattgaaaaatttgagaaggaggctgctgagatgggacagggctccttcaagtatgcctggg

SEQ ID NO: 315776 - DNA, 850 bp, Homo sapiens
cacccgggtctccccaggtagggcttcggccattcacttcggctggcccaatgttagcccgtgcccattcccgattgatccgggcccggtttcgggactcaccatggctcagcccgcagaccctatctagcctttcaacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccctgaaaaaaaaaa

SEQ ID NO: 315777 - DNA, 956 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacaggtcagcgccctcccttctccagcctacctcacaccgccgtaccttgggcaaaaaagtgcaggagttatgtcaatttgcctaggttcacttcgcgccccctctgacagggtgaccttacccgttacctctgtgtttcacttttgtcctctgtgaaatggggatgataacagtacctgcttcatagacaggtaggaatcaaattaggtgatgtctgtaagtcccttagcacaggatctaggacgtattgagtgttgaaaaaaactgtactgttaatcctttaggttagtcgccgaccctcggtgggtttacctatgaactattccatcccacccttccgtgatct

SEQ ID NO: 315778 - DNA, 2112 bp, Homo sapiens
  misc_feature (1330)..(1330): n is a, c, g, or t
  misc_feature (1340)..(1340): n is a, c, g, or t
  misc_feature (1476)..(1476): n is a, c, g, or t
cattgaaactccactgaaaatgccatgggtggtttatggcaacttttacatgagtctagcaaaaggaaagaatgtgtcacctcttttctatcacaattgggggcttaagaatgcaggggtggatgtatcaacccccagaaagttacaagtttaagccaggaattctggccaggcaatcatttttagtaatacccttgagcttatgggagtggaagtttgtatttttttttttccaaagtacattactactaatgataatagttttcattagttctagtcactgggcttagcgttttccatattttaccctcatagcaacctatgaaacctgtgtaggaattgacatttgatgacaaggtctgttcaaatccagcacccatgtgttacttaccactctttataattttttaaaagagatttctccttctgaataccactatttttttttgaatggcagaataagaaaaattaaaatctgaaaagctcttagaaaatactgctacaatatctggaacctagtaatgctgcttcatgtagcctctccagactcttgcctgtggcttcccaaagactggcataaacaagaggaaaagaaaaatggacaaaatggggattactagtggtaatcttgactacttggtttgagcagagccctctaggatgtgtgggaggagcaggaaaggccagaggctgggaaggctgggccatgcacagttctgctagagaagaaaagctgtacattatatgagtagcatgagtctattctacttttaccttcagtctcattgggctaaacaaaaacttcatgggttggagaaaagcttatttatcttttctcagcatccagagaggcatgtgactgaaatgcagtcatggacagacgcgagactggaacctgagtgtacaattaccactgtggtgagatcagcaacattgtattcagacaggccatttacttacctgcagcctatggagtaaccagaatagactcttgcccttatgtgacccacttgttggaatgagtgtggatctttccatttatctatcacttcccatatgcatttttgtttttagtttttattatatgcaagcatatttattttatggaggttgagtaggaaacctaagctaaaggaagcctcagtgatatagttcaaaacttggaatggctctcccagtagctatagtcctcggtactgtatttcctgaaatccatgtctcatcccttcttgtaagtatggaacacacccagtggctcacgcctgtaatcccagcactttgggaggctgaggtgggcggatcacttgaggtcaggagttcgagaccagcntggccaacanggtgagaccccatctctaataaaaatataaaaattagccaggcatggtggtgtgtgcctgtagtcccagctactcaggaggttgaggcaggagaatctcttgaacccaggtggcagaggttgcagtgagccaagantgcgccactgcactccagcctgggtaacagggtgagactccgtctcaaaaaaaaaaaaagtatggaacacaccaacacttgtgatttcctctagggaatggaattcagaatgggagtcacctttggattttttgaaatatagttctgtattggtgagactgctttaacaacttgtatttcttctgtggttgtgctttggatgaatatagcccatccaaggtgacttctttacaaacactgaacaactttgggtggtagggaagtgggaactgcattactctctgatataataactaaccacaccattttcattttgctttgccagggtgagttctgcatcctggtacttcctcaatgtatttgggcttcggagcatttactctctgattctgggccaagataatgacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacga

SEQ ID NO: 315779 - DNA, 2012 bp, Homo sapiens
  misc_feature (1361)..(1361): n is a, c, g, or t
  misc_feature (1365)..(1365): n is a, c, g, or t
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgaaaaaaaaaaaaaaanaaanaaaaaaaaaaaaaacacaacaaaaacaaaaacacaaacaaaaaacaaaaaaaaaaaacaaaaagggggggccccccacaccccatacccccctctagagcgggagctccaacagtcaatcggagaccaccaccacctgtcatatttctgtacaaaaacgggtcgcctaccactatcagatgtaagatacacatatcaaacacaacatgtgatattggcgccgagaccacacacacaacgcgtgttagctgaatcactcccgctccccgtgacaaacccgcccgacgacacgacgccccacaaacttgcggcgggcgcccaaccaaaaacgctagcgacccccaccccaccaacgccgacccacacgcccgaacgacggccaatcaacacaaccctcagcccgtgctcaaccgccgtcacccaccaaaccacagagccgacaccgcccgacgaccaacagttgctccgcacaccggcgcacgaacccccgcaaccacaaatccaacggggcccaccaccgaacaaccacgcccccccacaccccaaccgcaccaccaccgccacgcccccctcccaccagcgccgcccgcgccgcacccccccgccacccaccgccacgcaccccccaggcccctcccccccaacgcc

SEQ ID NO: 315780 - DNA, 1942 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagaaaatatctttcaggcctggtgcaatggctcacacctataatcccagcactttggggggctgagatgggaggatcccttgagcccaggaatttgagaccaaccttggcagcatgtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccctgaaaaaaaaaa

SEQ ID NO: 315781 - DNA, 1303 bp, Homo sapiens
agtggcgccatctcagctcattgcaacctctgcctcttgggctcaggtgatccttctactgcagcctcctgagtagctgggactacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccctgaaaaaaaaaa

SEQ ID NO: 315782 - DNA, 1271 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggacagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacga

SEQ ID NO: 315783 - DNA, 1239 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactggtatgtttgttcccttcactcatctttaaggaagatttttaacatgggtatttgagtggggtggggtaggcagggagggtgtcattttatttaaatgttaaattgcaaaagatagtaatcttagaccttagaaatcatctgatacagggatctatggaagtggaattctctttttcagttagattttctgagaaccccaatgtataaagtggattaaaaaaaatagttctcagctgatggagtggggaggccagagctattgtccctgggtctctccttattgctgttctcaggacccaggattctagggagcacagttggtaaagcattccagcctggctgtcacccagtgcctggatccccttccaatagatggctgcccagcttctgcctaaatgaggaagagtgcagtacttccaagatgtgccattttgttgactttgttgttagacgtgattgtttggtctaccctac

SEQ ID NO: 315784 - DNA, 1828 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccctgaaaaaaaaaa

SEQ ID NO: 315785 - DNA, 707 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgtatatttcaaccccagaggtgg

SEQ ID NO: 315786 - DNA, 508 bp, Homo sapiens
tccatcccacccgttcgttgagaagagtgccaggtgcgttacagcgtcacacagggtgacatttaggacttcacaccaagccttctgggtattgggctttttccactatactacagcgatcactttatctttctgtagcattagtttcagaactgaccagagccagcaccccaccctggagcgaaccttaagaagtcagcttactggccgggcatggtggctcatgcctgtactcccagcactttgggaggccgaggcggacggatcacgaggtcaggagatcgagaccatcctggctaacatggtgaaaccccgtctctactaaaaatacaaaaaattagctgagcgtggtatgctgggcgcctgtagtcccagctactcgggaggctgaggcagtggaattgcttgaacccaggaggcggagcttgcagtgagccaagatcgcgccactgcacttcaacctgggtgacagagcaagactctgtctcaaaaaaacagaaaagaagtc

SEQ ID NO: 315787 - DNA, 1312 bp, Homo sapiens
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaaggtatactccttcacctttcaaagctgcagcaatgctctgaaaggtgttaccaagagctattttaaaaatagcttccttgaagggagtgttgtgtggttccatcgttttaatttaaacttagtaaaaacatagtttacacgtctctctttcctgagacagaatcatctattaagtaaatggaaattcttggtgctttt

SEQ ID NO: 315788 - DNA, 1523 bp, Homo sapiens
aacaggtattaaaccaaagctgtaaaatacatgaatgaaatatattagactaggtttggggatagattatgtgtaaaaaatggttctcagacttgacaaatatactactgacattttggaaaggaagaaacactgattcttaagaatttggaactctggtttgagaagtactgactttaaagttttattccaagaaaatatctttcaggcctggtgcaatggctcacacctataatcccagcactttggggggctgagatgggaggatcccttgagcccaggaatttgagaccaaccttggcagcatgtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccctgaaaaaaaaaa

SEQ ID NO: 315789 - DNA, 1577 bp, Homo sapiens
  misc_feature (1286)..(1286): n is a, c, g, or t
  misc_feature (1290)..(1290): n is a, c, g, or t
gcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggacagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgaaaaaaaaaaaaaaanaaanaaaaaaaaaaaaaaattttgggcccccccgcggccccacaagaaagaaacttattaaagaaaccaaacccgcgttggtggagcgcgcgggcggacccccaaaagagagtatcacgaacctgttgggcacgaaacgagtttcccaaggaagaacccccgggtcacggaacgaggggggaactccccaccagataaaaaagggccggggacacaccgaagcctctggaacaacccgagagggaacagagaccaagggggcaaacaggggtccaggacacgaataaatgc

SEQ ID NO: 315790 - DNA, 912 bp, Homo sapiens
gccagccagtgaggctgtagtccagttctctaatctgtgtgaagcccattcttccccttgggtgctggggtgcttgctgagtcctggcactcatgtaagtgtgtcttatgctacagccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccctgaaaaaaaaaa

SEQ ID NO: 315791 - DNA, 2138 bp, Homo sapiens
cggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccaca

SEQ ID NO: 315792 - DNA, 339 bp, Homo sapiens
cggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagcccgtagcagtcgggagcgtgtgtgaaccgtagtcaggcctgcaatgtcgaggggagaagttgctccttcattgcgaggacgataggagccatggcgggttttgaatggtggagggaagggatccgaaaaagga

SEQ ID NO: 315793 - DNA, 2041 bp, Homo sapiens
cggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccaca

SEQ ID NO: 315794 - DNA, 10071 bp, Homo sapiens
tccggcgcggcgccgccagccagcctcggcggggagagtgcaggtactttgccttcagaataattagcaggacccaagccggctttccgagcgcgctttctttttcttcctttgccccctccctccggaaaagaagatcccacttttgaaacaatcagaaatcgaagcaccccaccaaagccaaaccctgacgggctgctgtgcatgtgccatccctttttgcagtttattctgggcctgtgtggaatagaaagacaattctttatttgactggtaggaaagaaaagagaagactcctcagggtttccaaggaggactggagcggctgctttagtgaagaagtgaagaatcaaggaagtaaaggacctgtctcaaagtcacacaactaggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315795 - DNA, 10010 bp, Homo sapiens
tccggcgcggcgccgccagccagcctcggcggggagagtgcaggtactttgccttcagaataattagcaggacccaagccggctttccgagcgcgctttctttttcttcctttgccccctccctccggaaaagaagatcccacttttgaaacaatcagaaatcgaagcaccccaccaaagccaaaccctgacgggctgctgtgcatgtgccatccctttttgcagtttattctgggcctgtgtggaatagaaagacaattctttatttgactggtaggaaagaaaagagaagactcctcagggtttccaaggaggactggagcggctgctttagtgaagaagtgaagaatcaaggaagtaaaggacctgtctcaaagtcacacaactaggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315796 - DNA, 9537 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcactatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315797 - DNA, 9537 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagtaaacccgacaggaagagggcagagtccgactctagagtagaactgaggcgccttaactttcaaacaccgggttcagatgattccggttaccctggtaaccttcattcttcaagtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcactatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315798 - DNA, 7055 bp, Homo sapiens
ctagtatctcagcctactttaataaagtaagacaaggagcatatttccacaaaggtatgtaggtcaaacattgcctgttttgttttgttttggtaagtaagaaaatgggaataccagtagagtggaactccctcatttggcaatgactgaaatgtgaacgttcagattggttggtcttaccactccatcccatgtgctccagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcactatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315799 - DNA, 2717 bp, Homo sapiens
  misc_feature (1)..(1): n is a, c, g, or t
ngaggcccaaggataaagttgcgcaaacatatatacttatatgccctatttataagggggccatggaataatagcagtgtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315800 - DNA, 4832 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtaagaataagtatccacctctttccttttaaaaattttccctcagagtccctatgttgcatattttattctgttcagaatctaacctttccctaaggcttatctttctaacagatactaattatgaatgggcatcaacaactctaattaaaccattctttaaaactcctctgggtgttttcacaaaagaaattctcccatgttatgatgtgtgtggttgctaaaaagt

SEQ ID NO: 315801 - DNA, 2869 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaagtaggtgtctctctttgcttactttctgcctttttatttcctcggggagatgttgctagctttcaccttcaccaataagcaaacctgctaatatgcttaatagttagtctctaggttagtatgcatcacacttcacaggtgaaagtgtaactgtgacttcttttggtctcatcacttgatccaaataacagatcccaccttcccacttcctacactgaaagacttttaaagaaggtagtagacgtccatgggtgaaatgtgggttaaaggagttagatcaagccctgtttaatgaattacaagtctttaaagcaaaattcacattgagaaccctgtaaaataatcataggagggcttcgcaaatgaaagaggctgcaaaagacaaaaaaaaactttatttttttaagcacacaggctttagctttgcaatcaaacaagtccttatttcatgtatttgtttctactaagaaaagctcagctctgatgacttgtttcttattaactctgtgtgtagtacctgtggaaatttggaacattgacagaaaatctgtatgtggacaaattaagaaacaatggaataatcgcaaacatatttgcaattctaaattgtattttgtttcctggggttcaatttctttttggagctgttacccttaagcatagctgtgtttatcacaatgggggttaattgttcccagggcagattgttttgcataaagtattatacaggattttgtttttggtggaaagtttggtggcttattattattaattgctttttattagtatgtgtttacagttcattcataaaaaatactatttaccttgaa

SEQ ID NO: 315802 - DNA, 1776 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggtactgatttttctccctcttctctttctctgttacttaatgggtggtccatgtttgtgatgtcatagcctgtttcagagtctgtctttctccttttctctgtgtgttttgcagcttctgtttaatccacattgctcactgctgtgactgtatttttggtaattttttaatttactgctttttcgcagtatttgatggatccattttctcctctttctttcttctttctctgttttcttttgaaacaaatttatttcaacattggacttcattcagaacttgcaaggagatccaatggttgtatccattaaaaaataaaatgttcatattaaaccctaaaatgtttcaattttattaaagtatgttttctgctatcttttctacatttgaactcatcaaagtaccaaagtttagtaagtctgggcacatctgctttcttttcactaatacataaaaacacagaaacgttatctcatgagtaaccagatgtatgtttttaaaagtctttagaaaataccagtaaaaggaggggatttttattaatactatgataataacattgtgagtgaacattttctacacattagccacagtagtgtgcgcccgtcaaggtttttgaaccctccagtgactggatctacagaagtctgcttttggtgtagactccagcttttgctgttttctctctctctttacccttttctccttttcccattcccatcccaagtttatgcctttgctctcttagattttcacagggatatataataataagctgtttactttgacattggtagtaatattggtatagaattctaagttgtttaactgcctgtcttcccagaattctcagcttttgacctgtcctgtgatgttaaagcgtcttgttaactgcctcttttgcttgttgtcagcagaattgtgtagattagcattctggtattgtaaatgaagaattaattattcacatgtaacatagatgatttagtat

SEQ ID NO: 315803 - DNA, 440 bp, Homo sapiens
gctcacctggttgaataacactccttgttttccagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtaagaataagtatccacctctttccttttaaaaattttccctcagagtccctatgttgcatattttattctgttcagaatctaacctttccctaaggcttatctttctaacagatactaattatgaatgggcatcaacaactctaattaaaccattctttaaaactcctctgggtgttttcacaaaagaaattctcccatgttatgatgtgtgtggttgctaaaaagt

SEQ ID NO: 315804 - DNA, 626 bp, Homo sapiens
gtaattttttaatttactgctttttcgcagtatttgatggatccattttctcctctttctttcttctttctctgttttcttttgaaacaaatttatttcaacattggacttcattcagaacttgcaaggagatccaatggttgtatccattaaaaaataaaatgttcatattaaaccctaaaatgtttcaattttattaaagtatgttttctgctatcttttctacatttgaactcatcaaagtaccaaagtttagtaagtctgggcacatctgctttcttttcactaatacataaaaacacagaaacgttatctcatgagtaaccagatgtatgtttttaaaagtctttagaaaataccagtaaaaggaggggatttttattaatactatgataataacattgtgagtgaacattttctacacattagccacagtagtgtgcgcccgtcaaggtttttgaaccctccagtgactggatctacagaagtctgcttttggtgtagactccagcttttgctgttttctctctctctttacccttttctccttttcccattcccatcccaagtttatgcctttgctctcttagattaaaagtagagataattctaaatttcttaagttt

SEQ ID NO: 315805 - DNA, 433 bp, Homo sapiens
aacagatctccatagcatgagctcaggcatgaaatttccagggcttagcatggctgcaagggatgtgcgagcatttgcagaatgaaggcagacggccttgtttttcccccagagcattagtagcatgttttgaatcagtgacattctattttgtcatttcaggacatgatcatttctgggctccagcctgaaacttcctactccctcaccgtcacagcctacacaaccaaaggagatggtgctcgcagcaagcccaaactggtgtccaccactggggcaggtaatcatgtctgtgcatgtatgtgccttgaacagtaatactaactttttaaatggtataggtagcttctagcaggcttttattatagtaaaatcagaggaaataaatggactatggtcaacttttgtgtttttagttcaggggtaaaaaaaa

SEQ ID NO: 315806 - DNA, 440 bp, Homo sapiens
cactgcaagagtaaataaatttaggatttcaagagtaaataaatttaggatttaaaggtatgtgagtgtggacaatatttatagcagataaaccataactaagtttctatttaaacatgttcctaactttttctaccctttttgttttcgggaaatgaaaatgattgttcttgtggtccgtatgcttgctgaatcctcctggcgtcttcctttgcggccgggtatgtggctttccttctaaaggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcaggtaagtttccatttgtgaataaagcagtgataagtggtggtg

SEQ ID NO: 315807 - DNA, 9961 bp, Homo sapiens
tccggcgcggcgccgccagccagcctcggcggggagagtgcagtttattctgggcctgtgtggaatagaaagacaattctttatttgactggtaggaaagaaaagagaagactcctcagggtttccaaggaggactggagcggctgctttagtgaagaagtgaagaatcaaggaagtaaaggacctgtctcaaagtcacacaactaggaaatcttgaggagtctgatacttttcatcctccagctataaaatcatcttgtagggggaagctgtacattggtggaaaataaaaggcaagcagttcctggcccgtgatattccagttagaggtgtctgactgacagcatgttggcaccgagggaagcgatgggcttcggctccaggtttctgtcctgagaccacagcagaatgtgccttggacaaaggcttggactccttgatcttctggtaacttcaaaaatctggtctcagggtggtgaactttttcttcgaattcctaacctgtgagcttacgaaaaagggagcatgcctgtcttattctcagtgcctcatgggaaataaaagattgggagatgatagctacctgatgatggtgcctgtccattaactgaacaactgtggttttgaacttcttgaggccagggactgtgtctgaaaacaccgacggtggctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315808 - DNA, 9591 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315809 - DNA, 7606 bp, Homo sapiens
ttattgttcgtttatttatttttgccttttcttttgttttatcattttttttttcaaccactcctgtcctttcacttaaatcctcctttaactcactaccaaaataagagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcactatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315810 - DNA, 5775 bp, Homo sapiens
ctggagcgactgaagaagattcgggcccatagagggctgcgtcacttctggggccttcgtgtcttcctcgtgccgaattcggcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaagtaaacccgacaggaagagggcagagtccgactctagagtagaactgaggcgccttaactttcaaacaccgggttcagatgattccggttaccctggtaaccttcattcttcaagtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcactatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattcacagtttaataatctaacctgaaaaataatgaagagaatcctgactgatgaggcatctgaaggattttatttacagatacctcaaggattcaaaatcaagggaagaagaaatcacagcaaagaaccaccatcttattcaggattgcttgaaaggtgcaaggagaaattgccagaatgctgcagttcagcacaagatatgtgctggtgtggcttctcacaatgaaacggactctgctttgacatcgccccttcccaccatactgctcataataacattttagggggaaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagttacataactcttcatttttttatttccaaatcgtaggtttttttaagctgtagaactgttatctgtaatatcttgctgtagaaatatcaaatcatttgaaaatttgcacatttttgtgcaaaactcaatctacagtatcagtctcgtcagatatattaattttacacttcagttttgattggtgagaaagtacccattctcttcaaataatcaaagataattattattttgttttgtttttggaatcaacagggaggcgcaaagtataaagttgctgctaacatatatacatatatatccatattttataagggtgtctatgtatatatagacagtgtgtccacacaaaaaatagatacagttatcagtcagtcagttcttccatgatttagtttttttaaacgtagaaaagctattgtaaacatctctttccatttattcttaattttttgacatattggtatttctttaaagggaaatgaggaatgcacatcagtgattgattgtcaaacctcaccccctgatttcctacctaatctacccccacctaaccaatcaatcacatccacaaattgttttgtttgtttgttagtcaggcttccaacaaagttcaatatttctaacactctagtgcaataaaaattattattaaatagctaagaggtgtgcatgtgggaaaggtcagtgcatatccctttaggaggggagaatgttgtaatatatcagctatcgagttgtttaaaaaaagtgtattcaatcgtatattgtctatagtatgtgctatgaaatttgcatttatgatatgtaacaggggcaaagccaaattcatgttactctgttcagtcagaaacattttgtggcatacagcattcctgggaagtgctgtactttgtttcgttttggttttagttttgcatttagagtgccttataattgatgcctattttaatagcatttctttttagcttttggttcgtatttccattcactgttcgtatctgttactttctattaaagcattatctgtttaccacatgtacaaaaactctttgaataatatgcattcctagttttcagccaagtcggggatgttagtgattgtaccagcccaaagcacttggataatcagggcccttcttccttttataatcaatcatcaacatcagaaaaagctacttgttttatttatattcccttccaaatccgctctggaacatgcagtaactgcaccaaacttattttagtaacaaatatcattggcaactttggaatatatttgatattccattaggatttttctaaaaggggaaataaactatatatatatatgtatcttacccccaattcttccaacagaatttctataggaagccatggatgatggcataagtttgccacatattacatgattttaaataatcctcaaaatacccaaggaactcttaaagagttttggtatgagtatactactttggtttaattttagcttcatggatgttctgcatggaaggatttttgttttccacattttcccattgctagcagagtgaaatccaagagaccaaacatttgcaagcattgtatttgagcacttttgtaaaaaacaaagaaaaagaaaaaaaagaaaatatatataatactaaaaaaaagtatctagaaggctacctcagaatgagactctctaacctacatcagaaccagagaagaatgtgcactatgtgggtctgttatcattattttcttttagtttgtatctttttggagatttatccaagtgccagattactcagtgctataattttcttttagttaaacaaagggggtcagacagacattgcatcatccagacatgccttgttggacatgtagaatccgatggagcactgcacaccagaatgattggccaatgagcagcttctctccctgaaacaataactgcccatttggcaaagggaaagatgacaataatcagaagaagaaaatgaatgggatgcataccatagacgaacgaggcggagactattgcgggaatcttactgttcaggagctgttcctagaactaactcccttactgtcattgatgtgcattccactctgtgcttttctgtacaaccattcaagttttaatttcccaggtgaaccatctttatctgccattaccacaagctttcaagtttccagttattttcatcatcataaccagtacggtgctattatttacctatgtacgtgtagttatgtataattttgtaattagttacaatggtaaaaaaaatcaaaatatataaaaagtgatttgtacagaactttattttagctcttttttaaaaatgatttgcatggttagaaaacggcgaggacagccaggggagggaagggcctctagggaactttgcactttctatacctttgtactatgcactgccctattgattctacacccaataatgatattacttgaacccatctgtaagaaactgcttcggaaattcatttgtgtgtatgtaaataacacaacatagaaacaggaagggaaaaaagtctgcagtaatgcacgtattttttttctttcctgtttattttcggttttgctttaagtccttttatttttaattccctttttgtttttctttttgggttttggttccttttgggtttatgggtgccctgatactccagcagagatcagaaggctacagatccattctatccatccgttatgtggctttgccatcccagcttggagtgtctttacaaagataataacagttgtgttctttgctctcgttttggatgcatagactgaaaaattaaaacaaataacttgtaaaatggcttgttaaaaaatacaattacctctaattagtagtacgcgtaaatgttttacagaatgaaaggcgtgctttttattttcttacttcgttacattggtggcgaaagaagtctgtatgaaaatcagttctttgctgacacaagttccatttgttacaaatgaattctaataaaaatgtcagtgttatgcaaaaaaag

SEQ ID NO: 315811 - DNA, 2441 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatggtatgttgcctccgctacgtcagtttgcacccttctgacacagtcttgatctgctgtctttcaataggctcacagtaatcttttttctctgctcat

SEQ ID NO: 315812 - DNA, 2762 bp, Homo sapiens
cggcggccgctgctccgcgggattaaattggccgcccggaggcggcggcgcggccgtggcggggcgcgaaggcgctggaggaaagtgttggcggcggcgcgggaggcggtggcggcggctgcccggggccaacatgaccaggctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacaggtaagcctctgaaattatgtacctctgtttttatataataagtttatcttagttcatatcctgaaattgctcttattttagtttttcgacatttaaaaaatcctatacaaaattctagttttcatttcacattgatgtatattgatcttttcaatcagagttactatcaagtgaggaagggaattgtaatgaaatgacactcaagtctgattaaaaacatgtt

SEQ ID NO: 315813 - DNA, 219 bp, Homo sapiens
aaagtttcactaggtaagtatgcaaattcttattctaaaaatacttctttaagtgcatgaagcttcatgtattttgcaatattcttggcctcaatatctaccccctagtgaaacttttctagaattatttttcactctaagtcatgtatgtttctctttgattatttgcatgttatgtttaataagctactagcaaaataaaacatagcaaatggcatc

SEQ ID NO: 315814 - DNA, 1802 bp, Homo sapiens
aaaaaaaaaaaaaaaaaaaaaaaaaaaaaaaaaaaaaaaaaaaaaaaaaattccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315815 - DNA, 1773 bp, Homo sapiens
aaaaaaaaaaaaaaaaaaaaattccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315816 - DNA, 3395 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtatatatagtcaaatatgtgtctagtacaaataaaatgtatctctaaggcataaaatgttttaacacaccacttttagtgaactctatcttatggtacagcggcctttcatcaaaggatcatcattgagactgagttgactggcagatatgtgcgatggatattacattaggtacaatgtgtatttttgattttcatgagttttctacattaaggtaaattccttagagtgtgatagcagcctcagtttatttgttggtttaaacttgaaatctactttttctcgataaaactataatgtagatgaattgaaaatgaattttcttttccctgtctacaaaagtcactatcaagccttggaaacctattctcaaatagagggtagataatgtgccataaattctcttttagaaagaatgtgatggaattaaatgagctttgtctctatactacttagaggaaacatcttctcagcagacagtctgtctgcatctttaaaagcctttgatttctctctatccaaagtcctatgttattctcatgcctaagaagcaaaactatgacttttaaaacagcagttccctttgtagttaatgttggttgacaaagacaaagttaagcacttagtgacactttgttgtagaagcatctgggaaaggaatataccctgtttaggaacaactcctctt

SEQ ID NO: 315817 - DNA, 2168 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatca

SEQ ID NO: 315818 - DNA, 2971 bp, Homo sapiens
  misc_feature (2518)..(2518): n is a, c, g, or t
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcaaaaaaaaaaaaaaaaaaaaaaaaaaaaaaaaaaatttggggggggcatgggcccagaaaagttttttaaaacctttcgttgtggccaccggggccccacaaagtgacaatgtacaacaaggtggctcaaaaagagggttcccaagaggaaaacccgggagacgacagaaacaagggcgcgggaaatcacatccaacacaatataaaaaagacgcgcccgggggtgaaacacaccagatgagttttcgtaaaacaacaactccaacaaaagggagagatctctagaacgaggacacactcaagcgggagggccatatctctaccaacagcgcggaggcgcgcaacaaagcaccaaaagagcccaagaagaacaaagacacagtatatctagcagccccccacgcagccctcaggcggggcnccaacccgacacagcgcagcaacaaaacgacaagaggaaaaggatgaacacagcgaaacgaaaacacgaaggaacagacacgcaacgaaaaagaacaggaaagaagaacacaaagaaagagaaaggaaaacacgaaagaaacgaacaaaaaagagaaagaaatagaaacaagaagaaacaagcaaaaaagaaagaagaacagaagcaacgaacaagaaacagacaagaaagaaaaacaaacaaagaaaagaagagaacagaaaagagagaaaaagaacaggaaacaaaaaacaatacaaaacaacaaagaagaaaaaagaagaaggaagacaagaagaagagagaagagagaagaaggcagaagaggaaaagaaaaacagagaagaaaaggaagaagagaagaaacaaaaaaaatagaagcacgaagacaagaaagaagaacaagacagaaat

SEQ ID NO: 315819 - DNA, 1872 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315820 - DNA, 1749 bp, Homo sapiens
aaaaaaaaaaaaaaaaaaaaaaaaaaaaaaaaaaaaaaaaaaaaaaaaaaatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315821 - DNA, 1787 bp, Homo sapiens
  misc_feature (1771)..(1771): n is a, c, g, or t
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtggggggggatgtcgactggcaaatgatgggcaaagcgtgtgacgggtggcagggaaggcngccgggggtgagaagc

SEQ ID NO: 315822 - DNA, 1962 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315823 - DNA, 1489 bp, Homo sapiens
aaaaaaaaaaaaaaaaaaaaaaaaaaaaaaaaaaaaaaaaaaaaaaaaaattccgtcctgacagagttcacagcatatattggtggattcttgtccatagtgcatctgctttaagaattaacgaaagcagtgtcaagacagtaagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315824 - DNA, 1735 bp, Homo sapiens
  misc_feature (8)..(8): n is a, c, g, or t
  misc_feature (75)..(75): n is a, c, g, or t
  misc_feature (365)..(365): n is a, c, g, or t
  misc_feature (467)..(467): n is a, c, g, or t
tgtctctnttggcagtttgttcctttcgccggctggtccggtccggatttcccgggttgccgtgtcaagacagtngggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttggggttccccggtttgccccttttggtggccgggcctttgggattgtngctggtctgccgtggctctttctgggtcccccccttctgggcccctcccgggttcccgggggggttttctcttccttggcacccctgacgaggctgcctttngcccgccaccgccctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315825 - DNA, 760 bp, Homo sapiens
  misc_feature (37)..(37): n is a, c, g, or t
  misc_feature (43)..(43): n is a, c, g, or t
gcgacttagaggatcccctgattcggttgcactactncaaganagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315826 - DNA, 2097 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315827 - DNA, 1779 bp, Homo sapiens
aaaaaaaaaaaaaaaaaaaaaaaaaaaaaaaaaaaaaaaaaaaaaaaaaacatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315828 - DNA, 2190 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcaaaaaaatttctgcaagtgtaaatgtgatgcagtttaacaaaacccattgttctgtacctatgaatagattttcaaaatgtcataaaaagtgc

SEQ ID NO: 315829 - DNA, 1910 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctgtgggtaataaatggggtgctctggccattttgatattcaatggggtacaagggcggttggcgcaatgggaataggagggaaaattaaaaaggagtcgggtaaa

SEQ ID NO: 315830 - DNA, 1974 bp, Homo sapiens
  misc_feature (1808)..(1808): n is a, c, g, or t
  misc_feature (1812)..(1812): n is a, c, g, or t
  misc_feature (1820)..(1820): n is a, c, g, or t
  misc_feature (1833)..(1836): n is a, c, g, or t
  misc_feature (1849)..(1849): n is a, c, g, or t
  misc_feature (1852)..(1852): n is a, c, g, or t
  misc_feature (1856)..(1856): n is a, c, g, or t
  misc_feature (1860)..(1860): n is a, c, g, or t
  misc_feature (1869)..(1869): n is a, c, g, or t
  misc_feature (1873)..(1873): n is a, c, g, or t
  misc_feature (1875)..(1875): n is a, c, g, or t
  misc_feature (1881)..(1881): n is a, c, g, or t
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctangtcncaaagtgnttaattcttggtnnnnctctggccaattntgnactnaatngtggtaaangggnanttgggnattgatagagatgctagagttagaagatggtacggagtagattaaacgtttgttgtgttgaaaaagggaaaaaggcatagggaatattatagc

SEQ ID NO: 315831 - DNA, 1735 bp, Homo sapiens
tatcatagaggagtccatagcgagctcgtagtatcatagattacgccaccgcaccgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315832 - DNA, 2038 bp, Homo sapiens
ggctgagcacattgcacttaattgttgccacagccacagatgtaaagaggcttgtaagaaaaatgttctcacagtgagcttccttatttgaagcaggactcaattcttggttaaaagctatggtatttgagctagttaaacacatatctctctcccattccatagggaatgagctgggctgtcctttctccccacgttcacctgcacttcgttagagagcagtgttcacatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagatacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315833 - DNA, 1048 bp, Homo sapiens
agcttattacagccaatacgttttgcacagccctggccctgctatggtaagtgtccgtgttcatctctgataccctatgagatccttggtgcattacttgtgcttgctttctctgcgttatccctggcccgggcgtggaatcctgatccgttatatgcaaacgacatattccaagaactgttacgctaccttgatcggtctagtaaacatcgcgtttcatatcattactatgagccgttgccagagtcgaagtctacagcattgtcgaaagtttagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatc

SEQ ID NO: 315834 - DNA, 5541 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315835 - DNA, 4324 bp, Homo sapiens
atctatcctcttttcaccacattttagtgagaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315836 - DNA, 3946 bp, Homo sapiens
aaactaaacaaataaatgtattgcattttggaacattttaatgacatctcttcttttaatccccatttcttctcattcactttcacattatagatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315837 - DNA, 5487 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315838 - DNA, 3023 bp, Homo sapiens
gtgcctcaccctcccaagtagctgggattacaggcaccaccaccatgcccagctaatttttgtatttttagttgagagcgagttttgccatgttggccaagctggtctcgaactcctgacctcaggtgatccacctgcctcagcctccaaagtgctgggattacaggcatgagccaccacatctagcctagtggcatttttaacatttagttttatagactttctatctatagattgaattaattttttaaattaaactatagcttaataactggttaatattaaacatgttttcagggggaaaaaaaaaagaattaacaagtaaccagactatttccagagtccttcaggtgtccttttggtaaaaactatttttccttctttttacttgctttactcatttatttattcgtttgttcatcgatcttttaaatggcagtatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315839 - DNA, 2141 bp, Homo sapiens
cgagcggccgcccgggcaggtacgcgggagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315840 - DNA, 1424 bp, Homo sapiens
  misc_feature (37)..(37): n is a, c, g, or t
  misc_feature (50)..(50): n is a, c, g, or t
tttccgctacacaattatttgaacaacccgcctgtgntgtttattaaaangcaggcgtcgtcgaatccggatgtggttagttaaactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315841 - DNA, 4191 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacattttacctggtgagaccgctttaggcctggcctggtggctactttacacttggtaaaggtctaggaggcaccacaaggctttctggcctttcgggagaatattagagagagaatatcatgttctaccctctggaatctaacctctgggttctctgggtgatgtatatctcctgggatgagatagcgcctatgtgagaggtgtcttctcaaaacagtgtttccgcgcaggtatatttctccccgctctgagtatggagcaaatggggtctgagatgtgagaggcgtgtaacgggagaacaacagaacacctacctgcataaaagtctcgcgtctttacatctgacgatctgcgggcgtgcagcacacattctgcgtggcgcataaaagaggtgggcgcgtcttttccaaacaatctttcctccccttgctacaagcattaaaatctcggggcggcttctccacgaggagaagagacatctccatgggggacacaacaaatatatttctctgtcggggcccacaagcagtatttttatacctcctccccaatcttattggggcgacacacacgggggagtatgcgtctgtgcatagtgtttggggaccccccttttttaatccacgcctctcgcgcgaatattcccgggaatcactttatagaccccatacaacctctccacacaatcttatttccacagggggccatcccttgctgtgttgtgtgccgacacactctaaaaagctttcttcacagcacagaacagacatttctaccactcggggggaggattctcaacgaagaacaagctttcgtgagggcactcccacaagagagttaaa

SEQ ID NO: 315842 - DNA, 2904 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcgtaatcctatgaggtttacgtaggttaagttgaggccaggtgtggtggctcccacctctaattccagcacttcaggaggccaaggcaggaggatcacttgaggtagaaacgttgaagcacaatgatccttttgctcctggtggaacagttgttgcagcaagcgattcaggtaaataaataatttatcaacttcattgaacattaaacattttttttaagattcttttttctttgtctctaaatatatttgtcctgttatttatagctttaaaattattgcataattatatccaatagtaatttaccaataataagcatttgtatatcactttctacttatctttcattctttcatttattattcatgttgaatattacactagaatatgaactctacccagtatcagtaaaccaataaaaatgttttgctttataaaatg

SEQ ID NO: 315843 - DNA, 1535 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggcacaagaataatgtgggacaggatcatgaaggtgccgggagataaatatgacaccgaggtaaaccgatagtttcaggtta

SEQ ID NO: 315844 - DNA, 4573 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttctt

SEQ ID NO: 315845 - DNA, 5396 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaacatgataccagtagtcctttgctaatcagtggaacctctgcagctgagctcccatgggctgtaaaatgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315846 - DNA, 4200 bp, Homo sapiens
tcactcggtattgcatacattatacgcaaagttactgcgatcacgggccaacatccggggcccggagccgtcgcacattccgctctgaacgagccagcggacgtgctgcacaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 315847 - DNA, 4974 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaatctcatagagttgtattctaacttatgtatgtgtactggatacatagtgtt

SEQ ID NO: 315848 - DNA, 3237 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttatgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaggaatctcaaaccttttgtattcccatgctcacaggtagttttgatacacattgtaaatagtgtcgagc

SEQ ID NO: 315849 - DNA, 1424 bp, Homo sapiens
taagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttattttcctcattttccacaagagccagatgaaataggcagaatacatattaccacattttaaaaatgcagaaagagaaacttaaagtgacttgaattcttgttcacagacggagtctcactctgtcactcaggctggagtgcagtggcgggatctcagctcactgcagcctcggcctcctggattcaagttattcttccacctcagcctcctgaggagctgggattacaggcatgcaccaccacccccggctaatttttatatttttagtagagacagcgtttcgccgtgtttgccagactggtctcgagctcctgataataggtgatccactcgcctcggcctcccaaagtgccgggattacaggcatgagccacctcttcaggcccaagacaaaaatatagttagagtagatggggaatagtagtgtcatcatttgataaacagtagt

SEQ ID NO: 315850 - DNA, 1632 bp, Homo sapiens
tttaacacccatagtaggcctaaaagcagccaccaattatgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315851 - DNA, 797 bp, Homo sapiens
  misc_feature (17)..(17): n is a, c, g, or t
  misc_feature (20)..(20): n is a, c, g, or t
  misc_feature (769)..(769): n is a, c, g, or t
tcgcgcggagcacaacnatnggctaggtacgaggctgggtgttgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaatcatcgacggaccggtcctaaacgctcctagagaaggtaccgttgtgagaatccagcagattgccantccagatggtgtggtgacatcacccgga

SEQ ID NO: 315852 - DNA, 145 bp, Homo sapiens
gcggccgcctactactactactactgctcgaattcaagcttctaacgatgtacggggccatgcaggatgcttgatgctgcgtcccccgctgcttgccgccccccaccccgccattttgtataataaagctccctgtgtattctca

SEQ ID NO: 315853 - DNA, 1680 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315854 - DNA, 1635 bp, Homo sapiens
  misc_feature (17)..(17): n is a, c, g, or t
  misc_feature (20)..(20): n is a, c, g, or t
tcgcgcggagcacaacnatnggctaggtacgaggctgggtgttgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315855 - DNA, 2004 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctcaaaaaaaaaaaaaaaagaaaaaaaaaaaataaaaaaaaaaaaccgaaaaaaaaaaaaaaaaaaaaaaaacaaacaaaaagaaagaaagagcggggggcgcccgcaaaacagccccccacggcgggcaacacaatcggcactaccccccgtcttctgtgaaacaacggcccccccataaggacggctcatttactacgcgagcgccgggcgccttaaaacacgccgcgtcgtggtgtgagaaacacgcccgcaagcggacccttctgggcagagagccccaccaccgcgggccgaacgagcgatcgtctgggggcaacccccgcgg

SEQ ID NO: 315856 - DNA, 2015 bp, Homo sapiens
acggcaagagctctgccagggcagtcccagctggcccaggcgccgcagcgctcccgagggccgtcgagcaaaggcgggaggcgcagccgggctgtcggtggacctgtaggtatcagggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccacgagcagggcggggccctaacctccgacccaggctggtcgccgcagatgggggcagagatgtgaaacagctgcagagcgggacaagggtgctgccggcacagggctgaccacagagcacatcaaaagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315857 - DNA, 1680 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctgtgggcactgcgtctgcattctcttcctagagcaggtttgtgtttggtatatgagtaaaggcctttgggttcagtgggcacaggttcttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315858 - DNA, 1364 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgattccacaagcaccttctcatacttcccatgcccggagacat

SEQ ID NO: 315859 - DNA, 1645 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315860 - DNA, 1047 bp, Homo sapiens
gcacgaggcgagctctgttcgatggtcccctccaagaccaaggggctgggtgtcctgggctgctgacatttctggtgctcctcctgttcctcctcagcccctgcggcccccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315861 - DNA, 1129 bp, Homo sapiens
  misc_feature (1098)..(1098): n is a, c, g, or t
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagacaccccatctnggaagaggaaagtttgcctcttctgagcagg

SEQ ID NO: 315862 - DNA, 987 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgaggtatgacctggctcccctctgctgtcaggtccctcctgcatcctggcaccattccttcatccaaccaacgcccttccatccaatcagtgccgccttattcaaccaacaccctat

SEQ ID NO: 315863 - DNA, 1059 bp, Homo sapiens
  misc_feature (862)..(862): n is a, c, g, or t
gggtttggcagagatgtgttttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctcaaaaaaaaaaaaaaaagaaaaaaaaaaaataaaaagggggggcggttcaaaattttccctccggggggccaaatttaagctaccccagttttttgttaaaagtgggcccctatggggggcttttaaaaagtaggcaggggccgtttaacacacgttcgtttacgtggaaaacctttgctctacgctgtggggcccttttgtagaggggaccccttactttcctggggcgtgtgacactattgcgccaacctacccttacagagatttaaacgagccccaaggcgcaaattattacaattagcacgggtgtactacgtgtgtaaccagtagcgtgcaatatttcattggcactgctagaaaagattttgggccgtaacgggggagatttttgaattttgaatggaaaaaatttttttatttaccgggggagcttatgttataaataccgngatatatcagatcagtaagacgacatgatagacaagagagaaatgatgatagaagataaagaacgtgatagagcgataggattaacatactggaatcgataggcatcatgcaagatctgatatatcataatactagagcataatgatcaatgaagagatcaaagaatcaataagagaaggaagagaataagccaaaa

SEQ ID NO: 315864 - DNA, 1441 bp, Homo sapiens
acggcaagagctctgccagggcagtcccagctggcccaggcgccgcagcgctcccgagggccgtcgagcaaaggcgggaggcgcagccgggctgtcggtggacctgtaggtatcagggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccacgagcagggcggggccctaacctccgacccaggctggtcgccgcagatgggggcagagatgtgaaacagctgcagagcgggacaagggtgctgccggcacagggctgaccacagagcacatcaaaagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggtgagtgagggcctcgagggcgggcgctgggcagagcagggctccctctggacctcgagggcgggcgctgggcagagcagggctccctctggacctcgagggcgggcgctgggcagagcagggcaccgcggagctcccttcaggccctcaacctgcgcctgagcagccaccccatcctcccctttccaagcagagcctgaaatgcccccatggccaggaaagggggagacaggaggggagggaggaagagggcgagacagcatggtggccggcgaggggccgcgaggaaacctcattctggggctccccagggcccctgggccccatccaggcagctgcgaggccaggccgggtgctgccacatcagcacacagctgcggccgcttccgtaatggaggctgagagcccgccgccgccccttcctccctcggggctggctgatctccattcccacggaggggagcaggtatttccagatgtgcatgccggagagtcggccgggaggacgcactttccagatgtggggatgtgtgtgcctgtctcaaccccaacaggcccaacaggggctgctcccgagccccacttcactacccc

SEQ ID NO: 315865 - DNA, 215 bp, Homo sapiens
tttaacacccatagtaggcctaaaagcagccaccaattatgaaagccacagcacgtacacccactccagggatctgccagcaccctgtggggcccagactacaggctgatggcggaggcttcgagtgacccgggtgccgaggagcgggaagagttgctggggtaagggtctgcggcgacgcccggcgccctgtgccgtgtccacgggtgcatagt

SEQ ID NO: 315866 - DNA, 392 bp, Homo sapiens
atcccaggccccctggccaggtaaggcaaggcgggagagaagggcccagggcttctactccccaagatccaggggtctgcccttgtgacatacccttctgctgcccccaggatattgtggctggagacatgagcaagaaaagcctctgggagcagaagggaggctccaagacctcatcaacaattaaggtagagcctaaatgtggttggtgcaggcagggtgggtgcagcaggggagggcaaagagggactgtcctctgtgcatctgggagggcttcccagaggcggaggcagcatcatctcctttctgctgctctcaccttcactcttggtctcctttcccaacagagcaccccatctgggaagaggtataagtttgtggccaccgggcat

SEQ ID NO: 315867 - DNA, 418 bp, Homo sapiens
agcctgcttaggactgctctcagctaccggcctcctctggatgacgggactgcaggaaccacgagaaccccagttctagctcccagggtgggcaggctgcttggcaggcaggccgccttccctccaccaggagtcaggtctccagccagaggtcctgacccagggcacaagtgctcgcactgggaagcaggcctctgaggcaggacgtcttctcctgtggtggagtgggggtgtgggcagggcagggaggccagcagagagaggctcggggagcaggctctgtgggcttgcaggaggcaggtctgtggcccctccctggaccctagcctaatgccccctgcaccccatgcctatgttccagcttcctgggtctgcaggtccagccggctggcaccctccatgtacccaggggagattc

SEQ ID NO: 315868 - DNA, 464 bp, Homo sapiens
ctgtggcgtgactgtccctctgtgtcccccactaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctgtgagcagccccataacgcgtgcctgggctctagcccctatccgtgtaccctggggcctgggcagagggggaggtcaagggcctgggcttgggggttccagtgcaggatgagagcgaggaagggcccccaggagcaggcgtgggagtgggtgagtgctcctggggcgagggtggccacagccctagaggagggtctgccaatacctggctgcctcctgggcgctgacccaggctctgtgtccgtgccctggcccttgctcggaccgcctctgaccccagccacgcagcctg

SEQ ID NO: 315869 - DNA, 909 bp, Homo sapiens
acgataatagtcataggtcgaggcctgggtgtttaatcaggctgaggcctcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgaggtatgacctggctcccctctgctgtcaggtccctcctgcatcctggcaccattccttcatccaaccaacgcccttccatccaatcagtgccgccttattcaaccaacaccctat

SEQ ID NO: 315870 - DNA, 450 bp, Homo sapiens
  misc_feature (419)..(419): n is a, c, g, or t
gggagtcacaaggtagagatctggagaccgaggggggctctgggagaggcttgggcaggttgggagaagccttgtgggagacatggggcctgacacatcttctaccctccagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagacaccccatctnggaagaggaaagtttgcctcttctgagcagg

SEQ ID NO: 315871 - DNA, 2325 bp, Homo sapiens
  misc_feature (2128)..(2128): n is a, c, g, or t
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctcaaaaaaaaaaaaaaaagaaaaaaaaaaaataaaaagggggggcggttcaaaattttccctccggggggccaaatttaagctaccccagttttttgttaaaagtgggcccctatggggggcttttaaaaagtaggcaggggccgtttaacacacgttcgtttacgtggaaaacctttgctctacgctgtggggcccttttgtagaggggaccccttactttcctggggcgtgtgacactattgcgccaacctacccttacagagatttaaacgagccccaaggcgcaaattattacaattagcacgggtgtactacgtgtgtaaccagtagcgtgcaatatttcattggcactgctagaaaagattttgggccgtaacgggggagatttttgaattttgaatggaaaaaatttttttatttaccgggggagcttatgttataaataccgngatatatcagatcagtaagacgacatgatagacaagagagaaatgatgatagaagataaagaacgtgatagagcgataggattaacatactggaatcgataggcatcatgcaagatctgatatatcataatactagagcataatgatcaatgaagagatcaaagaatcaataagagaaggaagagaataagccaaaa

SEQ ID NO: 315872 - DNA, 1791 bp, Homo sapiens
ctggcagggctggaagtcggtcttcggacagagcccgtcctgcccagaagcccaggcgagccagcagcaggggtgcagggaccgagtggcccagccccctgggcagggtgtcagggccagagcccagaggacggcggttcaggcttcagtcccagccggcgaaccagagctgggcagagcggccagcaagcggcagccagggtgccctgggcactcgacccccagatgcccctgctggaaccgtaaaggggaggcaccctgaggccagagggagcatggccccggggactgagcatccggctcagagcggcttggcagaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315873 - DNA, 1559 bp, Homo sapiens
acacagcttcttggtgctccaaagacgggcggtaggaggaagatcaaagaagcgagaaatggatgctggaggaacgcagtgaggccaggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315874 - DNA, 1576 bp, Homo sapiens
acggcaagagctctgccagggcagtcccagctggcccaggcgccgcagcgctcccgagggccgtcgagcaaaggcgggaggcgcagccgggctgtcggtggacctgcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315875 - DNA, 1381 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatctgcttgccgccccccaccccgccattttgtataataaagctccctgtgtattctca

SEQ ID NO: 315876 - DNA, 1629 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagaccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315877 - DNA, 851 bp, Homo sapiens
gcaattgttacgggccccctcgagtcgcggttctataagttgataccgctggccggacccccaagctagcccgccaggcctccatagagctgcccagcatggctgtggccagtaccaagagtcggtgggagacgggtgaggtacaggctcagtctgcggccaagactccgtcctgcaaggatattgtggctggagacatgagcaagaaaagcctctgggagcagaagggaggctccaagacctcatcaacaattaagagcaccccatctgggaagaggtataagtttgtggccaccgggcatgggaagtatgagaaggtgcttgtggaagggggcccggctccctaggcgtcccatctcgcttcctgggtctgcaggtccagccggctggcaccctccatgtacccaggggagattccagccagacacccgccccccggccctggctaagaagttgcttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315878 - DNA, 946 bp, Homo sapiens
gacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagcacgagggggcgcagggcgccttggacagcggagagcccccccagtgcaggagtcctgagggggagcaagaggacaggcccggcctgcatgcctacgaaaaggaggacagtgatgaagtccacctggaggagttgagtctgagcaaggaggggccaggcccagaggacactgtccaggacaacctgggggccgcaggggctgaggaggaacaggaggagcaccagaaatgtcagcagcccaggacacccagccccttggtcttggaggggaccatcgaacagagctcgcctcccctgagccctaccaccaaactcatcgacaggaccgagtccctaaaccgctccatagagaagagtaacagtgtgaagaaatcccagccagacttgcccatctccaagattgatcagtggctggaacaatacacccaggccatcgagacgtggccggacccaagtagcgcaggctcataagttgccagaatggtttggcagtcccagatcgtggaaacgt

SEQ ID NO: 315879 - DNA, 781 bp, Homo sapiens
tttaacacccatagtaggcctaaaagcagccaccaattatgaaagccacagcacgtacacccactccagggatctgccagcaccctgtggggcccagactacaggctgatggcggaggcttcgagtgacccgggtgccgaggagcgggaagagttgctggggcccactgctcagtggagcgtggaggacgaggaggaggccgtccacgagcaatgccagcatgagagagacaggcagcttcaggcccaggacgaggagggaggcggccatgtccccgagcggccgaagcaggagatgctcctcagcctgaagccctcggaggcccctgaactggatgaggacgagggctttggcgactggtcccagaggccagagcagcggcagcagttcctgttgccagcatgacctaccctcgcctctttgatgccatccgctgccacctccttttgctcctggaccctttagcctctctgcccttccactctctgaccaccgcccccgccctccccacccagctccgcttcttgttacttgggggaggaaagaaactcctgatcattggccaaagggacttacccctggagaggccaagtgccttctaggaagttaggaggttgaggcacagcctgtgcagagagggtgggtcacccccccagatccaaggggaaactgcaggtcaagggctgataacggccatgcaggatgcttgatgctgcgtcccccgctgcttgccgccccccaccccgccattttgtataataaagctccctgtgtattctca

SEQ ID NO: 315880 - DNA, 911 bp, Homo sapiens
  misc_feature (19)..(19): n is a, c, g, or t
  misc_feature (872)..(872): n is a, c, g, or t
aaaggctaggtacgaggcnggtgttgaatcggccgaggcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggagggtgaccctgagagtgtgggtgggagtatgggggggcccctctacaatggctggtacttcagccggncgggtttcgccggccccggtggggattttccggcccggg

SEQ ID NO: 315881 - DNA, 2226 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaagaaaaaaacaaaaagaattaaaaaaaaaaaaaagagaaaaacaaacaaaacttgggggggcgccaggcgccgtcgaaaagttttaaaacacaactgtatgttggaggccggggaccaagagggaggtgaacgatggccaagagagggagcccacaagaacaccgggggccaaccacggacggcggtggcgtcctacccaaaaaaaaaaccgcgggtgggacacggagggtcgtggaacaacacccggagggccgcgaggcacacgcgcgtctacaagcggccgagggccgaaataatggccgcgcgtggttggaga

SEQ ID NO: 315882 - DNA, 2344 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315883 - DNA, 2486 bp, Homo sapiens
gttacggcccgggaagtaacgggcatatcgtcgaagccaagacagtacgaccacgcgtcgagcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315884 - DNA, 2553 bp, Homo sapiens
accatcggacaatcaatcaagtgccttaggttgataccaaagcccggctaggacttttattaggactgaacgcgtatgtagttgtctgacttaagatagcaggcttggctgcattattgaatcgagagccgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315885 - DNA, 2463 bp, Homo sapiens
cggacgcgtgggtcgacccacgcgtccgacccacgcgtccgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315886 - DNA, 1948 bp, Homo sapiens
  misc_feature (1915)..(1915): n is a, c, g, or t
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcatcaaggtctctgtcccatcttcttcagggttgncgacgcggccgcgaatttagtagtagtagtagg

SEQ ID NO: 315887 - DNA, 2459 bp, Homo sapiens
cgagagagctaggtcgtgctggggtatcgcgtacgagcgccgagcaggcatgtcatgtttgcccgcgatgatcatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315888 - DNA, 2263 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315889 - DNA, 1863 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggtatgcctgtcccctgggcttggggtcttgtattaagtgttcagtatctttcattcactattgtgggcacatgaagtatatcggggaacaaaaagattcctggccttgtggtgctgccacaaggtgccaggtgtggtggctcatgccagtaatactagtactttaggggaggctggggtgggaggatcactctagcccaggagttcaagaccagcctgggcaacgtagtgagaccttttctctatt

SEQ ID NO: 315890 - DNA, 2434 bp, Homo sapiens
  misc_feature (2)..(2): n is a, c, g, or t
  misc_feature (21)..(21): n is a, c, g, or t
cncgtgcaattcggcagaggntgtgcatatcatagtcgctgggataagcgtaggggtcataagccgcctcagtgtcataatcatcagcgggataagacatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315891 - DNA, 2325 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatggcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315892 - DNA, 2409 bp, Homo sapiens
cggacgcgtgggtcgacccacgcgtccgacccacgcgtccgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315893 - DNA, 2377 bp, Homo sapiens
cggacgcgtgggtcgacccacgcgtccgacccacgcgtccgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315894 - DNA, 2077 bp, Homo sapiens
aaagtcatggaggccatggggttggattgaaaccagctttggggggttcgtttccttccttttttgccaaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315895 - DNA, 1321 bp, Homo sapiens
  misc_feature (1290)..(1290): n is a, c, g, or t
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtcaaaagaaattagagctgtcctctncgtcgaccgatcctctagaggatcctctaga

SEQ ID NO: 315896 - DNA, 1366 bp, Homo sapiens
  misc_feature (1344)..(1345): n is a, c, g, or t
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatggttcagttggatgtttaccagcgatggcgatgctggcctgtggcattgactccgagttcccgggttgtgtggagctccctccgctggggggattggggccaccgtcggccggccaaggggcccagtctagacttcgtctccgcccccttggcgttgtccagttcgggcccccaagctccgcgcggttgtggcgcgcccccctgctcaccggccggcgccggtccnnggcctgctggcgctggctcat

SEQ ID NO: 315897 - DNA, 2435 bp, Homo sapiens
aaggaatcaggcaggtagaggccggtggttaatcaggaagaagatcacgtcgaaggacatagtgtgatcccgggtgaagagaagtattctgatggcgcgattatcgatacctgtgctctatccccaggacttcattgtatagcagatgaggtaaaactccgacggctctcccctatactagagatcggactaaattgcgcataaagccacgtgattcagctgactactcatagtgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactcccgagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315898 - DNA, 1691 bp, Homo sapiens
  misc_feature (51)..(51): n is a, c, g, or t
  misc_feature (70)..(70): n is a, c, g, or t
  misc_feature (101)..(101): n is a, c, g, or t
cactctaaggatccgtaggtggttgtgggtagcaggatcagggttaggcanggacgggggtagagaaggnggtgggagagacagagagagagagacgacancctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315899 - DNA, 2385 bp, Homo sapiens
cggacgcgtgggtcgacccacgcgtccgacccacgcgtccgcaagaagagtatgtattcccgtgtgccagagtgccaggtcaccacatactattatgttgggtttgcatatttgatgatgcgtcgttaccaggatgccatccgggcttcgccaacatcctcctctacatccagaggaccaagagcatgttccagaggaccacgtacaagtatgagatgattaacaagcagaatgagcagatgcatgcgctgctggccattgccctcgacgatgtaccccatgcgtatcgatgagagcattcacctccagctgcgggagaaatatggggacaagatgttgcgcatgcagaaaggtgacccacaagtctatgaagaacttttcagttactccagcctgggcaacagaacaagactctgtcccagaaaaaaaaaaagaattaagtaaagatgtaattctaagatggtatgttcattgatacatggttagctgttgtgttcttcctaaccacagaaaaatattacagataatttttatttggtgtttggctcatgtgcatgtatgtgtttctgtcttccctgtccaaaaggacttaattgaaaaagcaaggaaaaataacaaaactgagatgtatagcattttagagctgaaggagattttagggattacctgatccagaaccttcttgtttacagctaaaaaaatggattcctcaaaacatacaacttaattgatgaataggaagatccgctctcaaactctgggactccagagcttcctctggatagttgagggcctctgcagggaaaactcttggtgtttctacctctggttctatctaggatgaattgggactcatgaatgtttgttctacctccttctacagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315900 - DNA, 1675 bp, Homo sapiens
  misc_feature (51)..(51): n is a, c, g, or t
  misc_feature (70)..(70): n is a, c, g, or t
  misc_feature (101)..(101): n is a, c, g, or t
cactctaaggatccgtaggtggttgtgggtagcaggatcagggttaggcanggacgggggtagagaaggnggtgggagagacagagagagagagacgacancctgggtggggctgacatcttgcctgtgaggggctgagctggggctggggaacaatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315901 - DNA, 1366 bp, Homo sapiens
caaacttttactttaagttggatccctgttatcagtaatactttagatgaacctcccctttcaaagtagtaaaaactaaagcacccgcgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315902 - DNA, 781 bp, Homo sapiens
aaataattaaatagtacactaccgaattatacatatatatatttttttctaggtgacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315903 - DNA, 646 bp, Homo sapiens
  misc_feature (1)..(1): n is a, c, g, or t
ngcacgagccttgataatacatcaaaacaggttcctgaatgtgtgtgaatatcatcaaggtctctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315904 - DNA, 394 bp, Homo sapiens
tggaaacgctgtgttaaagaatggtggccaaaaaagtagttcttatagcagaaaacagcaagcagttaaatatggctatagttaatgatacagaggcaggagattatcctgaaaagcttgatgggtccctaactgatacaaaaacaatattttcttgtgttgagaaagattgaagtgtggagttgggttgaggacagttgtgggcttgaagggctttggcctcagctctgtttatttgacatcttcccctttctaagcctgggtcctcatctgtaaaatgttaggattggcattctccagtccttttggaattttagagatttttttcttgatttttagctggaccaagctgactgaaagattcttcaagaatacaccttggcccgaggctgaa

SEQ ID NO: 315905 - DNA, 2450 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315906 - DNA, 1966 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaataagattacgagtacgagccgaaatcaccagagtagaggtgggcctgaaatgga

SEQ ID NO: 315907 - DNA, 2462 bp, Homo sapiens
  misc_feature (19)..(19): n is a, c, g, or t
aaaggctaggtacgaggcnggtgttgaatcggccgaggcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315908 - DNA, 2466 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagatggagtcttgtgctgtcacccatgctggagtgcagcgacgtgatcttagctcactgcaacctctgcctcctgggttcaagcgagtctccctcctcagcctcccgcatagctggaattacagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315909 - DNA, 2473 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggactgctcttggtcctctggatgtagcaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315910 - DNA, 2287 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggtatgcctgtcccctgggcttgggcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315911 - DNA, 2495 bp, Homo sapiens
aaggaatcaggcaggtagaggccggtggttaatcaggaagaagatcacgtcgaaggacatagtgtgatcccgggtgaagagaagtattctgatggcgcgattatcgatacctgtgctctatccccaggacttcattgtatagcagatgaggtaaaactccgacggctctcccctatactagagatcggactaaattgcgcataaagccacgtgattcagctgactactcatagtgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315912 - DNA, 2390 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactcccgagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315913 - DNA, 1634 bp, Homo sapiens
  misc_feature (1490)..(1490): n is a, c, g, or t
  misc_feature (1496)..(1496): n is a, c, g, or t
  misc_feature (1499)..(1499): n is a, c, g, or t
  misc_feature (1505)..(1505): n is a, c, g, or t
  misc_feature (1508)..(1508): n is a, c, g, or t
  misc_feature (1510)..(1510): n is a, c, g, or t
  misc_feature (1520)..(1521): n is a, c, g, or t
  misc_feature (1547)..(1547): n is a, c, g, or t
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagnccaagnagntcggancantntgtttaccannagaccgtggccggtcaccggggattnaacccagggcgcaggaggaccccggcaacgggccggggggtcccccagggacccaagggcgacaacgtggggccaaccccgctaaga

SEQ ID NO: 315914 - DNA, 2012 bp, Homo sapiens
cggacgcgtgggtcgacccacgcgtccgacccacgcgtcgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315915 - DNA, 2517 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgctacttgcctgcattattatacaagagtaattatactcagcagaggacctagtattagtgacccaaatgatcagctggagaggacgcgttccattgagaggtcagacgtgtttagagatctctattacaatttactggcaagtctctgttcatatctaactacttcttaagaggccgatggaagctgttccccttaaacctagccacaatcgaggaggactcttcggagtagttactcgattgagatttatctaccagttttcggggtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315916 - DNA, 1622 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttaga

SEQ ID NO: 315917 - DNA, 1520 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgcaccttgatggcctggtagtacggacgcgtgggccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgctgccgacttgttgtccatgccctacgttgggtattaatcacattcaaggtctttaccgaacaacgggaaaaaagggcccagtctagggcagcggaggtgaacgaaaaggtttttgcgggcaaaatattggttcctggccgatgtgggaagaaacctacagggaaggtggagctaccgatagtacagaaggtggctgacttgacccctttggatttgatgctcaccggggaactgaaacagcaacggtatcgagaacgtttgccaatttgattcgaagccaacacctgctggttgcagctcccttcataatgtgactggtgtggacactggcg

SEQ ID NO: 315918 - DNA, 1561 bp, Homo sapiens
atgcgtatggcgtacggtaatacgtgctggtgcaggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315919 - DNA, 1396 bp, Homo sapiens
tcatttagcgtctttccggcggtgctcgcaagcgaggcagccatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactcccgagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagagagggccgtttaacatcggggatcagaggttaacacaaacgtggacatggggtctga

SEQ ID NO: 315920 - DNA, 1410 bp, Homo sapiens
cggacgcgtgggtcgacccacgcgtccgacccacgcgtccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315921 - DNA, 1262 bp, Homo sapiens
acctagaggatccctccacgttgaatattagatgattatcaagctagaatgagcaggcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagaaaaaaaaaaaacaaaaaaaaaattcgggggattcattgtgggggggggaaaaagcgggtatggaaggggcccaggggccaatagggtgtccctgtgacccaagtttcttgggcacaaagggggaaaactctggcgggctccccatatagggagctcgaaataaatctcgaatagagccggggtacccggaattatagaatcgcgagaaaaagcacggacacaccgcagaagcaccacgagcaacgcacagacgcgagacccaaacacgagcacgcacccacgtcaccacacagacccagcagcacacgcgacaccccacccacaacaccgccccgcacacaagacaaagacagcccgaggccgcaggcgcaggcagaagagggcgaagagggggccgggggtggggagggggggggcgcgagaggcgagagagaggggagggaggggggggaggagaggaggggaggcggcggcgggaacgaaggaggggaacgcgagggagggggaggaagcgagggaaggacgacaggggcggaagggcggaag

SEQ ID NO: 315922 - DNA, 2095 bp, Homo sapiens
agcgcgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgttaaaataatagtgctaatttctaaatttataaaagtgcatagatttttcttaaaagtgagttttttctcccatagttaaaaatcgttggcatttgcagctgcttattcatgacagaatccagtaagaaatagtatcagatttagcagaaacactttttattgtcaacttagtatatcagtattttatgataatttccatatattctgccacatgatcaagttccaggacctctagagccctactctcagccatttatctgtgatataagagattccagggcagtgaaagtgattgaaaaaaagaactggtggtgctcacttcgccagcacatatactaaaattggaacaatacagagaaggttagcatggcccctgcacaaggatgac

SEQ ID NO: 315923 - DNA, 4397 bp, Homo sapiens
  misc_feature (2558)..(2558): n is a, c, g, or t
agcgcgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccntgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaaaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaactgctctggtgc

SEQ ID NO: 315924 - DNA, 4419 bp, Homo sapiens
  misc_feature (2433)..(2433): n is a, c, g, or t
agcgcgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccntgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaactgctctggtgc

SEQ ID NO: 315925 - DNA, 3715 bp, Homo sapiens
  misc_feature (1729)..(1729): n is a, c, g, or t
gggactcatctgtggttctctgcagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccntgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaactgctctggtgc

SEQ ID NO: 315926 - DNA, 3641 bp, Homo sapiens
  misc_feature (1655)..(1655): n is a, c, g, or t
gagccaccgcacctggccaaataaacaaatcttgatggttaaaaatagagatacacatcagagtagcctggtattgccaaatctgtgctgaagtatttagaatcaaatttaaaacatgggagtttgcaatgaagagatgtgtacacttcttctgccccaagggactttatcagggtgatactcttccacattcagagggctcctgaatcaatactttgatttaaagagagcagtcatcattttctgtgcgtgaccatgtttgttttgctattgcagatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccntgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaactgctctggtgc

SEQ ID NO: 315927 - DNA, 937 bp, Homo sapiens
agcgcgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcaggtaccaagttcttcagggcatcatgtctgtggttggctttcatcagtttcccagcaggatagagtgcttgtagagaaggctggaggccctgcatttgtttctaccagcattgagtcatttggtttcctagttccccttcttttggagtctgacgtgtaataagataagataatgggttcacagaaaatctctcattccgtgggattcccaaggtctagtacacaattatccactacagaagtcctgcctctctaagctttgcaactgtacgtacatctattaaaattcagctggtcccccctgaaaaaaaaaaa

SEQ ID NO: 315928 - DNA, 1785 bp, Homo sapiens
agcgcgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgctgctttcccatcagcctgatttctccaccttagaaaagggtttcttgacaatggggtcaggccccagaggagccccctgagagtgtcagttattatttactattacgtgctattttacatatcccaagccctttagggctacagtctcttgtcctggaccctgtagggtgccatttggagttcacagcctagaagaagaaaaggctttgggcctggtgtggtggcataggcctgtaatcgtagcgctttgagaggctgaggcaggaagatagcttgagctcagagagttcgagacaaacctgggcaatgtggggagaccccatctctaca

SEQ ID NO: 315929 - DNA, 4544 bp, Homo sapiens
  misc_feature (2558)..(2558): n is a, c, g, or t
agcgcgctgctgggctgcggcggcggcggcggcggtggttactatggcggagtcggccggagcctcctccttcttcccccttgttgtcctcctgctcgccggcagcggcgggtccgggccccggggggtccaggctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccntgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaactgctctggtgc

SEQ ID NO: 315930 - DNA, 598 bp, Homo sapiens
tttatgtgcgactgtaagaatcgggctttggactttggttctgtgaatctcagaagctcagaggtgcaggtagcactatggattcagggtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcacagaaactgctctggtgc

SEQ ID NO: 315931 - DNA, 470 bp, Homo sapiens
agctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtgagtgcatgcccttgttgggctagtggctcagcttggagatagggtaccccgtcatttcatttttttctactcttgcccactcacttggtttgacgataaagatgccttttggatgttcccgaaggtgacaaaggctggggtttctcagcagttgcttttgtagattagagggtgaggaagcagattttcaagttagtcccagaggtgcccgcagtgtttagagtagtggcttagcagccataggcag

SEQ ID NO: 315932 - DNA, 1483 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaac

SEQ ID NO: 315933 - DNA, 5352 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgacatttgtggtgtttcattttttaaattctcttgagtaacttctgtagccctttccagtgtgtcaggttgagccacatgaagttgctatttttgtaagtcaaaaatatcttcatagggtgcaactcactattctatggaatcttattttaggagtattgaaccttcctgaaatgtctttgaaggaagtgtcaccctttccaacactctgccagccataactgcttgggaacaggtctccaggatttgggttccatagagcagaaggtaggcctctgccctcatgtctagagggatgaataacattctgaaaaggtacagggtgtgtctagtcacaggagtcacctgcaaggctccaaactcaggctggatggccccttggggagtgaattctgcaagagttgcacctggggccaacagaaggagctggaatcactgattctgtatcctggctacatgccttagaccacaggaaccagactctgaagcaccacagatgtttctgtgaacatctggagttgggaatcactgagttagatcaagaatggattcggctgccatgctcgggttgagattgtattgacggatgaaggggaatgacggaagaattcctgcggtaaagtgctgtgaagacactcctgttttagaaagagctctctagccgcagcaaggaggattaactggaggcccaaggagtagtctggactttggggcagtaactttaggggggccctgagggagagctggtcgcgaggacagggacagcaggcagaggttgtggcccacagggcaatcgcaggagaggttgtgaataattcccaggtgatgagtgtgcagctttgaggaatttcaaagggttgcttggcgtcttttcctgaagacacttctataaggtatttagaaatctatcaggagtgagaatcagtccagtcagaaaattttaggcatttgggcaactgcattcagaaaacagctatttatttggaatgcataataaaagccatgagactgaatctccatgcctctttgccccctagtagccttcaagaagtctctaaaacagggttaccacagatttagccaggatgatgtgtagcagcttttcttggaacaggttgatggattaaaataactttttttcagctctaatgtttttttcttgaatttgccagtcacatgataattttcttcaaaaataaaactttataattgtaaaaaaaaaaag

SEQ ID NO: 315934 - DNA, 2626 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagctataatctcagcactttggagggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagcccttgtcttaaaaaaaaataacaccata

SEQ ID NO: 315935 - DNA, 5383 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgacatttgtggtgtttcattttttaaattctcttgagtaacttctgtagccctttccagtgtgtcaggttgagccacatgaagttgctatttttgtaagtcaaaaatatcttcatagggtgcaactcactattctatggaatcttattttaggagtattgaaccttcctgaaatgtctttgaaggaagtgtcaccctttccaacactctgccagccataactgcttgggaacaggtctccaggatttgggttccatagagcagaaggtaggcctctgccctcatgtctagagggatgaataacattctgaaaaggtacagggtgtgtctagtcacaggagtcacctgcaaggctccaaactcaggctggatggccccttggggagtgaattctgcaagagttgcacctggggccaacagaaggagctggaatcactgattctgtatcctggctacatgccttagaccacaggaaccagactctgaagcaccacagatgtttctgtgaacatctggagttgggaatcactgagttagatcaagaatggattcggctgccatgctcgggttgagattgtattgacggatgaaggggaatgacggaagaattcctgcggtaaagtgctgtgaagacactcctgttttagaaagagctctctagccgcagcaaggaggattaactggaggcccaaggagtagtctggactttggggcagtaactttaggggggccctgagggagagctggtcgcgaggacagggacagcaggcagaggttgtggcccacagggcaatcgcaggagaggttgtgaataattcccaggtgatgagtgtgcagctttgaggaatttcaaagggttgcttggcgtcttttcctgaagacacttctataaggtatttagaaatctatcaggagtgagaatcagtccagtcagaaaattttaggcatttgggcaactgcattcagaaaacagctatttatttggaatgcataataaaagccatgagactgaatctccatgcctctttgccccctagtagccttcaagaagtctctaaaacagggttaccacagatttagccaggatgatgtgtagcagcttttcttggaacaggttgatggattaaaataactttttttcagctctaatgtttttttcttgaatttgccagtcacatgataattttcttcaaaaataaaactttataattgtaaaaaaaaaaag

SEQ ID NO: 315936 - DNA, 5268 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtaggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgacatttgtggtgtttcattttttaaattctcttgagtaacttctgtagccctttccagtgtgtcaggttgagccacatgaagttgctatttttgtaagtcaaaaatatcttcatagggtgcaactcactattctatggaatcttattttaggagtattgaaccttcctgaaatgtctttgaaggaagtgtcaccctttccaacactctgccagccataactgcttgggaacaggtctccaggatttgggttccatagagcagaaggtaggcctctgccctcatgtctagagggatgaataacattctgaaaaggtacagggtgtgtctagtcacaggagtcacctgcaaggctccaaactcaggctggatggccccttggggagtgaattctgcaagagttgcacctggggccaacagaaggagctggaatcactgattctgtatcctggctacatgccttagaccacaggaaccagactctgaagcaccacagatgtttctgtgaacatctggagttgggaatcactgagttagatcaagaatggattcggctgccatgctcgggttgagattgtattgacggatgaaggggaatgacggaagaattcctgcggtaaagtgctgtgaagacactcctgttttagaaagagctctctagccgcagcaaggaggattaactggaggcccaaggagtagtctggactttggggcagtaactttaggggggccctgagggagagctggtcgcgaggacagggacagcaggcagaggttgtggcccacagggcaatcgcaggagaggttgtgaataattcccaggtgatgagtgtgcagctttgaggaatttcaaagggttgcttggcgtcttttcctgaagacacttctataaggtatttagaaatctatcaggagtgagaatcagtccagtcagaaaattttaggcatttgggcaactgcattcagaaaacagctatttatttggaatgcataataaaagccatgagactgaatctccatgcctctttgccccctagtagccttcaagaagtctctaaaacagggttaccacagatttagccaggatgatgtgtagcagcttttcttggaacaggttgatggattaaaataactttttttcagctctaatgtttttttcttgaatttgccagtcacatgataattttcttcaaaaataaaactttataattgtaaaaaaaaaaag

SEQ ID NO: 315937 - DNA, 5252 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttgatctgggcatttgtcatggatagtcagtcatgggttgtgccatttatgtgaagctctatcattgttcaatggtcctctatgagtagacaaagtactcaacacgttgactcggaactatgtatggctcctcctatggtcatttgtgcaagcatcttttctaagcacattggtgggctgctggagcgatgtagtgggaagacggtcttccttgctggcatgcattctactcagtgctctgggctatctccttctcggagcagccaccaatgtgtttctgtttgtcctggctagagtcccggcagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctgggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgacatttgtggtgtttcattttttaaattctcttgagtaacttctgtagccctttccagtgtgtcaggttgagccacatgaagttgctatttttgtaagtcaaaaatatcttcatagggtgcaactcactattctatggaatcttattttaggagtattgaaccttcctgaaatgtctttgaaggaagtgtcaccctttccaacactctgccagccataactgcttgggaacaggtctccaggatttgggttccatagagcagaaggtaggcctctgccctcatgtctagagggatgaataacattctgaaaaggtacagggtgtgtctagtcacaggagtcacctgcaaggctccaaactcaggctggatggccccttggggagtgaattctgcaagagttgcacctggggccaacagaaggagctggaatcactgattctgtatcctggctacatgccttagaccacaggaaccagactctgaagcaccacagatgtttctgtgaacatctggagttgggaatcactgagttagatcaagaatggattcggctgccatgctcgggttgagattgtattgacggatgaaggggaatgacggaagaattcctgcggtaaagtgctgtgaagacactcctgttttagaaagagctctctagccgcagcaaggaggattaactggaggcccaaggagtagtctggactttggggcagtaactttaggggggccctgagggagagctggtcgcgaggacagggacagcaggcagaggttgtggcccacagggcaatcgcaggagaggttgtgaataattcccaggtgatgagtgtgcagctttgaggaatttcaaagggttgcttggcgtcttttcctgaagacacttctataaggtatttagaaatctatcaggagtgagaatcagtccagtcagaaaattttaggcatttgggcaactgcattcagaaaacagctatttatttggaatgcataataaaagccatgagactgaatctccatgcctctttgccccctagtagccttcaagaagtctctaaaacagggttaccacagatttagccaggatgatgtgtagcagcttttcttggaacaggttgatggattaaaataactttttttcagctctaatgtttttttcttgaatttgccagtcacatgataattttcttcaaaaataaaactttataattgtaaaaaaaaaaag

SEQ ID NO: 315938 - DNA, 4163 bp, Homo sapiens
ggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgactccggtgccgtcggagcccgccgcttcctgctctgtctctacttggtgggcttcttggatttgtttggtgtcagcatggttgtgcctttattgagccttcatgtcaagtcccttggagcaagtccaacagttgctggaatagtagacgacgtatgttcaaagagattttgagatttgagcactataaccaagtcccatgccactagtggcaacaggtacttatggagcctctgcaaggagctggctgtgtgtataaaagggctcctcctatggcattttgcaactcttttctagcacattggtgggctgctggagcgatgtagtgggaagacggtcttccttgctggcatgcattctactcagtgctctgggctatctccttctcggagcagccaccaatgtgtttctgtttgtcctggctagagtcccggcaggtatttttaaacacactctctccatctcaagggctctactttctgatgtggttccagagaaggaacggccgcttgtaatcggacacttcaacacagcctccggtgtgggcttcatcttgggccccgtggtcggtggctatctcactgaattagaggatgggttttatctcacagccttcatctgctttttggtcttcattctcaatgctggtctcgtttggttctttccatggagggaagcaaaaccgggcagtacagagaagggcctgccattgcgaaagacccatgtgctgttgggaaggagccatgacacagtgcaggaggcagccaccagccgcagagccagggccagcaagaagactgcccagccctgggtcgaagtagtgttggccttgcggaacatgaagaacctgctgttttccgaaatgtgggacatatttctggtgcgcttgctgatggccatggcagtcatgctgtactacagtaactttgtcctggccctggaggagcgctttggggtgcggcccaaggtgacaggctacctcatcagttacagcagcatgctgggggccgtggccggccttgccctggggccaatcctacggctgtacaagcacaactcgcaggcactgctgctgcattccagcatactcacctgcacactgctgctgctctactccttggcccccaccatgggtgcagttgtcctctcctccactctcctgtccttctccactgccattggcaggacgtgcatcacggacctccagctgactgtgggcggggcccaggccagcggcacccttattggcgtggggcagtctgtgactgcagtgggccgcatcatcgcccctctcctctcgggggttgcccaggaggtcagcccttgcggcccccccagcctgggcgctgtgttagccttagtggccattttcataatgtctctaaacaagcgacactctagtggtgatgggaatagtaaattaaaaagtgagtagatggatttggacaacataaagcaacaaaatttgagatggttgaatgagggccggaggccatgatgaaaagggcactttggaaagggttggggtggaagggaaatatttccgggtgggtgtgagctgttgggcttccaggtcagctcttggccatgcagccatgcctgcaggatgatcagaagtcacggcacctcatgggaaggttaagactggagcaaagcttttccaaggtgagcatattcagcgtttacctggaagtctcttcttcccacctgggctaatcaggttacaattttcaagggtaaacaaactaccagctacaggatagggaagtggtggtggaataagagaacatgatacctggaggaagggaagaaaccacaagcattttcctactgaaaaatagggtgacatgtcagtcaaattctgatcaactggaacttgagtttccagttaaattccatacactaggagggagttttctatcaaaatcctgcagattgaagaagctggtttattagaaccagcctgtcgcttttcaaagctgcttaaaaataagatactgacctcacccctagagatgattcagtgggcctgggtggggccaagaaatccgtggtgttttgtaagcactgctggcgatttctcatggcagtaaagaccacactgagactgcactgattttgattaaagtacataggcttggctgtttttacacagctaactaaatttggactcttaaaattgtgtttgtaatcacagtgtgttacacctttcccagctctcagcagttgtactgcatgatggagcagcgggcccctgggacctgttccctgtgctccctgcctctgagagcccagcttgctctgaagttggactaaaccacttagatgctggggttgccacagcctgctcctggaagcctgcattccagtcaggttgcatccttctggtgctgacagaacccagtggtgaagccaaagcacaggaatgctttaaaaatgaacagtttatgcagaataagggtcaggagtcatgccagaccagaacttgatgctactgtgtcttgtgttaagaatcatttcctggccaggctcggtggctcaggcctgtaatcccagcactttgggaggctgaggcaggtgaatcacttggtcaggagatggagaccattctggctaacatggtgaaaccccgtctctactaaaaatacaaaaaaaaaattagccgggcgtgatggcgggcgcctgcagtcccagctattcgggaggctgaggtagaatggcgtgaacctgggaggcggagcttgcggtgagccaagattgtgccactgctctccagcctgggcgacagagtgagactccgtctcaaaaaaaaaagaatcatttcctttatttttagtttcacgcctgcaaacacaagcattctgttgatcaacggaaatattttgatgtgccatttcttgtctaaacaagtttcatatacagcaccgagggggccacgagaggcagaggcccagacagaaggtgaacatagccttgcagggagacatatgccaggcaggatgaccattgggattgcatcaagtattaatcagttacttaagggcttcctgtcagacagttgaagttcacattccttttacttttcttaattagtccactaggatggtatgcctgttttcaacttaacacatgcatacttgtaaatattttagtatgctacagtaatttgtcatatctttaatatttattgtttgtaaagcagtaaacatttctgtattttagaagtcatggagtaaaatcaaatatttatgataaataattggaagtatgttttagtttgaagattgtcctttttcctatcttgctgcaaggaaaaatggacttctgattaggttttacaattgtgaacttttatgtaaatgttaagtgctttcgaggagaccaaactattattaatatataaaatggccttgcccttaaggagcaaattaaatctcatggagattagactcaaaaggcaataaataatcgagggtttatgcaatgaaatagaatttcagaagagtttggatctcaaagattgtccttcactctcagaaacaggcaagtttcttaaaagcccttatagtcgtgtttttattttaaaaatcgtagcactttatttttgaagtttaaaaagcccataaacttaatgagtctttataatcagacacatggaaatatagaaaaccaaagactgatcttagaatatagagtagagagacatgtttgttattctccactagtgactttagtattttgttatgtgatgttttttaggtgcaccttttctcatgactccttttactttatctaatgtcttcctctttaaagtgtgacccagagaccagtagcatcagcatcacctgagacctgtgaacactgaagctccagctcagacatgttggggaccattttaataagatacctagctgattttttgcacagcaaactttgaaaacccctggtctaaggggtagtatttgtatcacttatggaatataatctcagggaaattaaatctgctcaattgaca

SEQ ID NO: 315939 - DNA, 2564 bp, Homo sapiens
ggcagggagagggggcggaatcggggcggtcccgggagcgccccgccccctccgcctccgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggcgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315940 - DNA, 2721 bp, Homo sapiens
ggcagggagagggggcggaatcggggcggtcccgggagcgccccgccccctccgcctccgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggcgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggcccctccctggagttacccttgctccttgcccctccagtcagccccacatccttgcagggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315941 - DNA, 3100 bp, Homo sapiens
ggcagggagagggggcggaatcggggcggtcccgggagcgccccgccccctccgcctccgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggcgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccagaaaaaaaaaaaaaaaaaaaaaaaaaaaaaaagggggggcgcgttaaaatttcccctcggaaaggggccccgaattttaacgccgttacccgcagtttttttgttccaagaggtggtcccctaataggtgaaggtcgatattatataaggcctgatgcacgatggcgacgccgtttaacactgtgcgatgaacggtgaaaaactcgtggctacctgggggaatctgtggagaagaggaaacctttaagtatcggggggggggtgggtgaaccaatagtttgggtgcaacagaaattttatctctataacaggagagaatttttaagaggggccctctatagggggggggtatagactttttataagaaattttttacacggtgtgttatatagtgtcggtgttttaagaatataggttaggacaatatttgtctattgggtgagttttggaatagagttttggggaatacacgaggagttatatgagtttatagtagacaaattttttattacaaggggagctaaggtgaaaataaga

SEQ ID NO: 315942 - DNA, 2418 bp, Homo sapiens
ggcagggagagggggcggaatcggggcggtcccgggagcgccccgccccctccgcctccgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggcgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315943 - DNA, 1476 bp, Homo sapiens
  misc_feature (98)..(98): n is a, c, g, or t
  misc_feature (127)..(127): n is a, c, g, or t
cctatgatggcctgctgggtaataatcagatctttcccaagacaggccttctgataatcgtcctgggcacaattgcaatggagggcgacacgcctctnaggaggaaatctgggaggagctgggtgtnatgggggtgtatgatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315944 - DNA, 1280 bp, Homo sapiens
tggtcactgttgaaagccttcattcagtccccctttctctagccagggctgcctggacccctggatgccctgattaccatccttaattctccctactaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggcccctccctggagttacccttgctccttgcccctccagtcagccccacatccttgcagggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315945 - DNA, 1245 bp, Homo sapiens
ttgagcatctcaccatccctgttgtcccatggagtggggaggctcctcactagaacaggttggagaaagagggcatcctatctccccagatgtcttcctacccctccctagaatcttctgaatgtagtaccttctggccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggcccctccctggagttacccttgctccttgcccctccagtcagccccacatccttgcagggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315946 - DNA, 1041 bp, Homo sapiens
gtaagcagtcgggtagtgtctgcaggtgggaccgaagaacggtggcggtgatatcaaaggatgctctttcgaacagtgttgcatcttccgtcagtagatgttagtactgcagagatgatgccagaaaatcttaggaaaaatttaactgaattgcttagagcagctttaaaaattagaatatgcctagaaaagcagcctgacccttttgcaccaagacaaaagaaaacactgcaggaggttcaggaagattttgtgttttcaaagtatcgtcatagagcccttcttttacctgagttgcgagctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccagaaaaaaaaaaaaaaaaaaaaaaaaaaaaaaagggggggcgcgttaaaatttcccctcggaaaggggccccgaattttaacgccgttacccgcagtttttttgttccaagaggtggtcccctaataggtgaaggtcgatattatataaggcctgatgcacgatggcgacgccgtttaacactgtgcgatgaacggtgaaaaactcgtggctacctgggggaatctgtggagaagaggaaacctttaagtatcggggggggggtgggtgaaccaatagtttgggtgcaacagaaattttatctctataacaggagagaatttttaagaggggccctctatagggggggggtatagactttttataagaaattttttacacggtgtgttatatagtgtcggtgttttaagaatataggttaggacaatatttgtctattgggtgagttttggaatagagttttggggaatacacgaggagttatatgagtttatagtagacaaattttttattacaaggggagctaaggtgaaaataaga

SEQ ID NO: 315947 - DNA, 2432 bp, Homo sapiens
ggcagggagagggggcggaatcggggcggtcccgggagcgccccgccccctccgcctccgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggcgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315948 - DNA, 2604 bp, Homo sapiens
ggcagggagagggggcggaatcggggcggtcccgggagcgccccgccccctccgcctccgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggcgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315949 - DNA, 1608 bp, Homo sapiens
  misc_feature (98)..(98): n is a, c, g, or t
  misc_feature (127)..(127): n is a, c, g, or t
cctatgatggcctgctgggtaataatcagatctttcccaagacaggccttctgataatcgtcctgggcacaattgcaatggagggcgacacgcctctnaggaggaaatctgggaggagctgggtgtnatgggggtgtatgatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315950 - DNA, 1347 bp, Homo sapiens
gtagagaagctgccagtgcggtatggctcccggtatgtttgcctgggtcagattcaggatgtaggtctcatggtccaggaccacgtgagagctcctggagtagtttccatctatttggtacacacggtaaccaggattaaggccgatgtaggtagttgcactgggtgccaggaaggctacagccagcggccggctcagagtctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 315951 - DNA, 1037 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggca

SEQ ID NO: 315952 - DNA, 1073 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagagcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggaggg

SEQ ID NO: 315953 - DNA, 723 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagactttttcaaaaaaaacctcgtgccg

SEQ ID NO: 315954 - DNA, 704 bp, Homo sapiens
tgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaattta

SEQ ID NO: 315955 - DNA, 636 bp, Homo sapiens
gacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcag

SEQ ID NO: 315956 - DNA, 531 bp, Homo sapiens
aggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtccatctgcctgtccatgtcgctccactttctacctggcgggatcctctagatcacccagca

SEQ ID NO: 315957 - DNA, 8431 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315958 - DNA, 8377 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaagttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315959 - DNA, 7265 bp, Homo sapiens
cgaagagaagaaatgcaccttgaggactctgccaactttattaaatatgagaccaatctgaccttcgttggctgcgtgggcatgctggatcctccgagaatcgaggtgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315960 - DNA, 8393 bp, Homo sapiens
  misc_feature (4222)..(4223): n is a, c, g, or t
  misc_feature (4225)..(4226): n is a, c, g, or t
  misc_feature (4229)..(4232): n is a, c, g, or t
  misc_feature (4244)..(4245): n is a, c, g, or t
  misc_feature (4248)..(4248): n is a, c, g, or t
  misc_feature (4252)..(4252): n is a, c, g, or t
  misc_feature (4255)..(4255): n is a, c, g, or t
  misc_feature (4265)..(4265): n is a, c, g, or t
  misc_feature (4268)..(4269): n is a, c, g, or t
  misc_feature (4272)..(4272): n is a, c, g, or t
  misc_feature (4286)..(4286): n is a, c, g, or t
  misc_feature (4293)..(4293): n is a, c, g, or t
  misc_feature (4304)..(4304): n is a, c, g, or t
  misc_feature (4307)..(4307): n is a, c, g, or t
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgnnannagnnnnaaaaaaaaaaannaanaaanaanaaaaaaaaanaannaanaaaaaaaaaaaaanaaaaaanaaaaaaaaaanaanaaaaaaaaaaaaaaaaacagaaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315961 - DNA, 6060 bp, Homo sapiens
tgatgctgcggtgatctagaggatcccgaaatggtcttgaggacttctgcatttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315962 - DNA, 7660 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcattctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315963 - DNA, 5710 bp, Homo sapiens
ctggaaactggagataaaataaactttgtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315964 - DNA, 5931 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaaccaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315965 - DNA, 5496 bp, Homo sapiens
acgagatgaggtagcggatgaactgtttcatgttagtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315966 - DNA, 8313 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaattta

SEQ ID NO: 315967 - DNA, 5593 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315968 - DNA, 8554 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaaaaaaaacgacaacaaaaatctcacaaaaaaaaacaaaccacaaaagatgccagaccaaaaataaacccccaagaaaaaaaaagggcacccaaaacccagcacccaaaagcgggcccaaaccaa

SEQ ID NO: 315969 - DNA, 6616 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315970 - DNA, 4955 bp, Homo sapiens
acgacccgtttatgagtggcagtgactccacttcctgatctctatgtcggaccctgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315971 - DNA, 8375 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315972 - DNA, 7949 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattacccttgtctcctgagatctcaccatactgatttcccttgacctaattagttcaagctcaaggcctatccatagaggattggttctatagctccaataggacagttgctcattaaccgtctttatgaatttttacagcttcgaca

SEQ ID NO: 315973 - DNA, 4415 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315974 - DNA, 3798 bp, Homo sapiens
ctgaggtacggtcgaattccggcgaccagcgtcggatcagtacgatgtccaactttctctccagttcgtgttgaagggtgcctttggccccaaaagggggagtaaaaaaaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315975 - DNA, 4341 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctaagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315976 - DNA, 2801 bp, Homo sapiens
ctgccaggtactccatggctaaggagtaagctggtttttgggctgtgctgctactggctgctcacttctccatcaaccttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315977 - DNA, 4619 bp, Homo sapiens
  misc_feature (4222)..(4223): n is a, c, g, or t
  misc_feature (4225)..(4226): n is a, c, g, or t
  misc_feature (4229)..(4232): n is a, c, g, or t
  misc_feature (4244)..(4245): n is a, c, g, or t
  misc_feature (4248)..(4248): n is a, c, g, or t
  misc_feature (4252)..(4252): n is a, c, g, or t
  misc_feature (4255)..(4255): n is a, c, g, or t
  misc_feature (4265)..(4265): n is a, c, g, or t
  misc_feature (4268)..(4269): n is a, c, g, or t
  misc_feature (4272)..(4272): n is a, c, g, or t
  misc_feature (4286)..(4286): n is a, c, g, or t
  misc_feature (4293)..(4293): n is a, c, g, or t
  misc_feature (4304)..(4304): n is a, c, g, or t
  misc_feature (4307)..(4307): n is a, c, g, or t
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgnnannagnnnnaaaaaaaaaaannaanaaanaanaaaaaaaaanaannaanaaaaaaaaaaaaanaaaaaanaaaaaaaaaanaanaaaaaaaaaaaaaaaaacagaaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagaga

SEQ ID NO: 315978 - DNA, 2382 bp, Homo sapiens
aacgatggtcctacagctgagtcgggacagaggcctctctcttccccgctcacctccggcccttggcgttgggcagatacaggcatcagcttctctaactctgcagcacttttgcttctgtcttgattcctctgctttttaggcacagttttcttctctaagaaagcgttcttgttctctagcttcctgttccctctagtgtcctcagcctttctcggggtcttctttttcctcctgcctctgacatcggtatcctcctcagcactcatggcactgtctaggggcttctcaaagccatgagagctgaggaccatcgttcaacgatggtcctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315979 - DNA, 1396 bp, Homo sapiens
aaatcccatcggtgcatgccgagaacgagcaggattggtggcaggctgcacacactctttaccaggttccaggtagttgcgggccacaaacttgagcgtctcatccatgagaatcacgggcaaggagattttcagcaccatcagccactgggtcacgttcagcggtgtgatctggaagatgagtggcaagggttcgacatagaggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315980 - DNA, 3753 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgggtgctgaaaatctccttgcccgtgattctcatggatgagacgctcaaggagattttcagcaccatcagccatgagaatctccttgcccgtgattct

SEQ ID NO: 315981 - DNA, 2811 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatctttgtttctttctgtgctggtaacaatgagcgtcgcacagacatggtttcaggtaaataaatctattctatgataaa

SEQ ID NO: 315982 - DNA, 2027 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaaaatgtatctttgggaaaacaattacagtttgttaatttgaaaa

SEQ ID NO: 315983 - DNA, 1990 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtatta

SEQ ID NO: 315984 - DNA, 1306 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtaaatatgatatattaagtcattgaatttctgaagaccttcgcatattccatgccaatagagttggctcttgcctcactgtccct

SEQ ID NO: 315985 - DNA, 509 bp, Homo sapiens
gttaattgaatatctttttaaagggggccatttgcttcctgttcacaataatttagcttttttgatggaatgaatcatggcatatacaactttattctctttgctgtgccttgtgtatatgtagtaagacttttacttactgctaagtaggaaagtattctttaaagtgaaagcttgaaggcctgtctgaagatacagagcaaaatttcttagaataatgtagttaggtttccttaagcctcattctcttccttcctaattcaaatcttgaatccatctaaagttttttatgactccaagataggttgatcactttgcttgttttaactgaattttatgtatttgtgttatatgcagatcatttattttctttaaaaattgatttggagacaaattcatctttagataacatagttttaaaagttgctcatttcagccgccttttttttctcctaattagttggtgacaaagttcctgctgatataaggttaacttccatcaaatctac

SEQ ID NO: 315986 - DNA, 354 bp, Homo sapiens
gacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacagtagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaa

SEQ ID NO: 315987 - DNA, 277 bp, Homo sapiens
ggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatg

SEQ ID NO: 315988 - DNA, 4458 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315989 - DNA, 4657 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagaga

SEQ ID NO: 315990 - DNA, 7766 bp, Homo sapiens
tatacatcaaaactgaggtacacgtgttaccagctttcatctttgtgtcatttgattctctttaggctggtttgattctacaacttccattctgaaatcgggaagaaaattactgtgacttctacacggttgatagttcatatatgatgtcatgagaaatatatagcttgggactggcagtgctatgatgagagtccagccattcattggtctttacaactggagggatagttcttagaatttgtgagagatactcatcactcatagcatttactgtgtgcccaaacacaatctaagcatgttacatatgacttcttatcctcacaaaccttgaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgataaa

SEQ ID NO: 315991 - DNA, 9028 bp, Homo sapiens
  misc_feature (3346)..(3346): n is a, c, g, or t
  misc_feature (3546)..(3546): n is a, c, g, or t
  misc_feature (3835)..(3835): n is a, c, g, or t
  misc_feature (4004)..(4004): n is a, c, g, or t
  misc_feature (4630)..(4632): n is a, c, g, or t
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagaatgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttcccagcacagaacaagactctggaaggagtaacggaccctctgcagctcttgtcaccacgtcaacaccctctgctttgccacagggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcancctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacatantgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaantccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttntccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttnnncatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaatgct

SEQ ID NO: 315992 - DNA, 9199 bp, Homo sapiens
  misc_feature (3517)..(3517): n is a, c, g, or t
  misc_feature (3717)..(3717): n is a, c, g, or t
  misc_feature (4006)..(4006): n is a, c, g, or t
  misc_feature (4175)..(4175): n is a, c, g, or t
  misc_feature (4801)..(4803): n is a, c, g, or t
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagaggaaacgtggtgggtgccgttttgacaccgacctatcctttgtgaggttgaagaattttggaagagcatgagagcagcacttggtgttcagaagaaaggcttagcatgttgtcctgggttccgtggagaagggtcactggactgcacggggtggctcttccgcatggtcttgacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagaatgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttcccagcacagaacaagactctggaaggagtaacggaccctctgcagctcttgtcaccacgtcaacaccctctgctttgccacagggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcancctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacatantgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaantccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttntccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttnnncatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaatgct

SEQ ID NO: 315993 - DNA, 6891 bp, Homo sapiens
  misc_feature (1209)..(1209): n is a, c, g, or t
  misc_feature (1409)..(1409): n is a, c, g, or t
  misc_feature (1698)..(1698): n is a, c, g, or t
  misc_feature (1867)..(1867): n is a, c, g, or t
  misc_feature (2493)..(2495): n is a, c, g, or t
cgggggacgaaagggaaaaaagtgagaccagaaagcctgaagaaccagtgcaccccagagccaagtggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttcccagcacagaacaagactctggaaggagtaacggaccctctgcagctcttgtcaccacgtcaacaccctctgctttgccacagggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcancctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacatantgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaantccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttntccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttnnncatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaatgct

SEQ ID NO: 315994 - DNA, 2956 bp, Homo sapiens
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagaggaaacgtggtgggtgccgttttgacaccgacctatcctttgtgaggttgaagaattttggaagagcatgagagcagcacttggtgttcagaagaaaggcttagcatgttgtcctgggttccgtggagaagggtcactggactgcacggggtggctcttccgcatggtcttgacaaaattgaagaagcacaaaaagaacttaatggggcagaagtttcaaaaaaagaaatcttacaggctggtgttaaaggaacttcggaatcccttaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaatgct

SEQ ID NO: 315995 - DNA, 8339 bp, Homo sapiens
  misc_feature (3346)..(3346): n is a, c, g, or t
  misc_feature (3546)..(3546): n is a, c, g, or t
  misc_feature (3835)..(3835): n is a, c, g, or t
  misc_feature (4004)..(4004): n is a, c, g, or t
  misc_feature (4630)..(4632): n is a, c, g, or t
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagaatgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttcccagcacagaacaagactctggaaggagtaacggaccctctgcagctcttgtcaccacgtcaacaccctctgctttgccacagggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcancctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacatantgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaantccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttntccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttnnncatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaatgct

SEQ ID NO: 315996 - DNA, 7253 bp, Homo sapiens
  misc_feature (3346)..(3346): n is a, c, g, or t
  misc_feature (3546)..(3546): n is a, c, g, or t
  misc_feature (3835)..(3835): n is a, c, g, or t
  misc_feature (4004)..(4004): n is a, c, g, or t
  misc_feature (4630)..(4632): n is a, c, g, or t
  misc_feature (7218)..(7218): n is a, c, g, or t
  misc_feature (7220)..(7220): n is a, c, g, or t
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatggggcagaagtttcaaaaaaagaaatcttacaggctggtgttaaaggaacttcggaatcccttaaaggtgtgaaacgcaaaaagatcgtagctgagaatcacctgaaaaaaataccaaaatccccactgagaaatcctcttcaggcaaaacataaacaaaatacagaagagtcatctttcgccgttcttcatagtgcttcggagtctcacaagaaacagaattatattcctgtaaaaaatgggaagcagtttaccaaacaaaatggagaaacacctggaataattgctgaagcctcaaaatctgaagaatctgtctccccaaagaagcccttgtttctgcagcaaccatctgaactgcgtagatggagatccgaaggcgctgatcctgccaaattcagtgacctcgatgaacaatgtgactcaagttccttgtcaagtaaaaccaggactgacaatagcgaatgcatctcttctcattgtggcactacgtccccctcctatacaaacactgcattcgatgtcttactgaaagcaatggagccagaactgagcaccttgtcacaaaagggctcaccttgtgcaattaagacagaaaaactgaggccaaataaaactgcacgttcccctcccaaattaaaaaacagttcaatggatgccccaaatcagacttcacaggaattggttgctgaatcacagtcttcttgtacctcatacacagtccatatgtctgctgctcagaagaatgagcaaggggcaatgcagtcagcttctcatttgtatcatcaacatgaacactttgttcccaaatccaaccaacataatcaacagcttccggggtgttcaggtttcacaggatcactgacaaatctgcaaaatcaagagaatgccaaacttgaacaggtttataatatagcagtgacatcatctgtaggcctaacttcaccttccagtagatctcaggttactcctcaaaaccagcaaatggattctgcttcacctttgtcaataagtccggctaattctacacagtcgccccccatgccaatctataattcaactcatgttgcctctgttgttaatcaaagcgtagagcaaatgtgcaatcttcttctgaaagatcagaagccaaaaaaacaaggaaaatatatttgtgagtattgcaatagagcatgtgcaaagcctagtgtgcttttaaagcatatccgctcccacactggagagcgaccctatccctgtgtgacttgtggattttcatttaagactaaaagtaatctgtataagcacaagaaatcccacgcacatactatcaaactgggtcttgtcttgcaaccagatgctggtggcttgttcttgtcccacgagtcccccaaagcacttagtattcattcagacgtagaagacagtggggagagcgaggaggaaggcgccactgatgagagacagcatgacctgggcgccatggagctgcagaatgtgcacataataaagaggatgtcaaatgctgaaactttactaaaatcaagcttcactccaagcagtccagaaaatgtgataggtgactttttgctacaggacagatctgcagaatcacaagctgtgacagagttaccgaaagttgtggtccaccatgtcactgtgtcccccttaagaactgacagtccaaaggccatggatcccaagcctgaactttctagtgcacaaaagcagaaggaccttcaggtgacaaacgtacagccactttcagccaacatgtcccagggtggagtctccaggttggagactaatgagaattcccaccagaaaggcgacatgaatccactggaaggaaagcaagactctcacgtaggaacggtacacgcccagctacaaaggcagcaggctaccgattactcccaagagcagcaaggaaagctcctgagtcctcgaagtttaggaagtacggattctggttacttttcacgttctgaaagtgccgatcaaacagtgagtccaccaactccctttgccagaaggttcccagcacagaacaagactctggaaggagtaacggaccctctgcagctcttgtcaccacgtcaacaccctctgctttgccacagggaaaaggcattgcttttaccaggtcagatgcgcccacctttggccacaaaaacacttgaggagcggatatcgaagcttatctcagacaatgaagctttggtagatgacaagcaactggatagtgtgaagccgcggagaacctcactgtcaagacgaggaagcattgattcccccaaatcatacatatttaaagattctttccagtttgatttaaaaccagtgggacggagaacaagttcaagctctgatataccgaagtcacctttcacccctactgaaaaatcaaagcaagtgtttcttctgtctgtaccttcacttgactgtttacctatcacaagaagtaattccatgccgaccacaggttattcagcagtacctgcaaatataatacctcctcctcatccactaagaggaagtcagtcatttgatgacaaaattggcgctttctatgatgatgtctttgtatcgggacctaacgctcctgtgccccagagtgggcatccccgtacacttgtgagacaagcagccatagaagactcttcagcaaatgaaagtcatgttcttggtactggacagtccctggatgagagccaccaaggatgccatgctgctggtgaagccatgtcagtgaggagcaaggcactggcacaaggcccacatatagaaaaaaagaagtctcatcaagggcgagggacaatgtttgagtgtgaaacttgtagaaacaggtataggaaactggaaaattttgaaaatcataagaaattttactgttctgagttacatggaccaaaaacaaaggtagccatgagagaacctgagcacagccctgtgcccggcggtctgcancctcagattctacactacagagtcgctgggtcctccggcatctgggaacagacgccccagataagaaaaaggaggaaaatgaaaagtgttggggatgatgaagaacttcagcaaaatgaaagtggaacatctccaaaaagttctgaaggccttcagtttcagaatgctctgggctgtaatcccagtttgcctaaacatantgttaccataagaagtgaccagcagcataaaaatatacagttgcaaaactcccatattcaccttgttgccaggggccctgagcagaccatggatcccaagctgtcgaccatcatggaacaacagataagttcagcagcccaggacaagatagaactgcagagacacggaactggaatctctgtcatccagcacaccaactccctgagcaggcccaactcatttgacaagcctgagccttttgaaagagcctccccagtttctttccaggagctgaatagaacggggaantccgggtctctaaaagtgataggaatctcccaagaggaaagtcacccttctcgggacgggtctcatcctcaccagcttgcactatcagacgctctcagaggagaacttcaggaaagctccagaaagagtccaagtgaacgacatgtgttaggacagccctcaagacttntccggcagcacaacatccaagttccagagattttggtcacagaagaaccagatcgagacctggaagctcaatgccatgatcaagaaaagtcagagaagttcagttggccccagcgtagtgaaaccttgtcaaaattgccaacagagaaactgccacccaaaaagaaaaggctccgtctggctgagatagaacattcctcaacagaatcgagctttgattccactctctccaggagtctaagtagggagagcagtttatctcacacttcaagtttctcagcctctttagacatagaggacgtttctaaaacggaggcttcccccaaaatcgattttctaaataaagccgagtttcttatgattccagctggcttgaatactctgaatgttcctggatgtcaccgggaaatgaggcgtactgcatcagaacagattaattgcacgcaaacgtcaatggaggtctctgatctcagaagcaaatcattcgattgtggaagcatcaccccaccccagacaacaccacttactgaattgcagcctccatcttcaccttctcgagtgggagtgactgggcatgtgcctctcttagaaagaaggagaggcccactggtacggcaaatatctttnnncatagccccagatagtcatctgtctcctgtacacccaacatctttccaaaatactgctcttcccagtgtgaatgcagtgccatatcaggggcctcagctcactagtacatctttagctgagttttctgcaaatactttgcactctcagactcaggttaaggatctgcaggcagaaacatcaaactccagctctaccaacgtttttcctgttcaacagctctgtgatatcaatttgttaaatcaaatccatgcaccgcctagccaccagagcacacagctatctctgcaagtgtctacgcagggtagcaagccagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaatttcttctgactcagggtagtccacagncntctgatgacacggggacctggaagtgtcgacgc

SEQ ID NO: 315997 - DNA, 329 bp, Homo sapiens
ttgtttgattagaattagctatattaagtgttgatgtaaaaagctggaatattctgttacacatgcataaaattgttattggttgagtataaaagttgtgccttgttttatctttgggttgaattttaatcatcaatattttctcagaggcatagtgtccaatctccctattcattttttttctttaaattagatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccc

SEQ ID NO: 315998 - DNA, 505 bp, Homo sapiens
gactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacaggtaaatgattggcagttgttcttttatttcttttttcgttttaacctattaaatatggagaacttaatggcttaagaaaataatgcacttaagtgatttttttaggccaaatcagtttgtatagctttatttttttcttgtatttaagggtagagggtatttttgccctttggagtcttgttgagtatcttaagcagttcagatattttattgtaaatctatgaaagaaccaaatggttcttgaaaaatacacccatttatttttatttgctttttgaaaaatttttgaaattaaaa

SEQ ID NO: 315999 - DNA, 4567 bp, Homo sapiens
ggagcgggggtctcacaggagggtctcaatctccggacctcaggatctggccggcctcggcctcccagggggctggggataacagggcgtgagccaccgcacccggccctaaaccctaggtttggacttcggtaagaaggaaagatttaaacaaacaaacaaacattaaattacaaccataataaacaaaaaaacactaaattaaattacaaccataataaaatctcccaaggtcggtaggcacggacatattacagcctggccaaatcagaatagatgtctcaggtgtggtcaatttaccagacacaaagagtagctcagatctcatagactcttcgagatctggtagactaatttcaagtctttttaaagtttggaaaaacatgtgctattgggaattacgtcatcctcgaaatattaacccggagctcaaaaacctatggttggatatgggaaatagttaagtccagttttcttctataaagataaaaattctgttttatctgggtcttctaaaagtgaggattgctttgctcccaaataccaattgcattgtcaggttttcacttcaggcccatcttgctcttctaatcctgtgcattctttgccaaatcaagttatttcagatccagttggaacagatcattgtgtgacatcagcaacattaccaaccaaattaattgacagcatgtctaattcgcatcctctgctaccaccagagctcaggccccttggaagtcaggtgcagaaggtgccatcatcattcatgctgcccatacgcctgcagagtagtgttcctgcttactgttttgctacactcacatccctgccacaaatactagtgacccaagatctgcccaatcagccaatttgccagactaatcatagtgtagtgccaatcagtgaagaacaaaattctgtgccaacattacaaaaaggtcatcagaatgctttgccaaacccagagaaggaatttctatgtgaaaatgttttttcagagatgagccaaaattcttctctatcagaatccttgcccataactcagaaaatatctgttggtcgactttcccctcaacaagaatcttcagcttcgagtaaaaggatgctttccccagcaaatagtttagacattgccatggaaaagcaccagaagcgggccaaagatgaaaatggagctgtttgtgcaacagacgtgagacctttagaggctttgagttcgagagttaatgaagctagtaaacagaagaagcctattttagtgagacaggtttgtactacagagcccctggacggtgtgatgttggaaaaggatgttttttctcaacctgaaattagtaatgaggctgttaatttgacaaatgttttaccagctgataattcatcaacaggatgctctaaatttgtcgttatagaacctataagtgaattgcaggaatttgaaaacatcaagtcatccacatcattaactcttacagttcgaagttcacctgctccttcagaaaatactcatatttctcctttgaaatgtacagacaataaccaagaaaggaagtctccaggggttaaaaatcaaggtgacaaagtgaacatccaagagcaaagtcaacagccagtcacttctctttcattgtttaacatcaaggacacccagcagctggctttccctagcctgaaaactacaaccaactttacatggtgttatctcttaaggcagaagtcgttgcatttgcctcagaaggaccagaaaacttcagcctatactgattggacagtaagcgccagtaatccaaatccactcggtttgcccacaaaagttgcacttgctctccttaattcaaaacagaacactggaaaatcactatactgtcaagcaataactacccattccaagtcagacttattggtctattcaagcaagtggaaaagcagcttaagcaagagagcattaggtaatcaaaagtccacagtagttgaattcagcaataaagatgcctctgaaattaacagtgagcaagataaagaaaattccttaatcaaaagtgaaccaagaagaattaaaatatttgatggaggatataagtcaaatgaagagtatgtatatgtccgaggcaggggaagaggaaaatacatttgtgaagaatgtggaatacgttgtaagaaacctagcatgttaaagaaacacatacgaacccatacagatgtccgcccctaccactgcacttactgtaacttctcctttaagactaaaggaaatctgacaaaacacatgaagtccaaggcacatagcaagaaatgtgtggatttaggcgtctcagtaggtttaatagatgaacaggatacagaagaatcagatgaaaaacagagattcagttatgagcgatctggatatgatcttgaagaatctgatggcccagatgaggatgacaatgaaaatgaagacgatgatgaggacagccaggctgaatcagtcctgtcagccacaccctcagtcacagctagcccgcagcaccttccatctagaagtagccttcaggaccctgtgagtactgacgaggatgtcaggatcaccgattgcttttctggggtacacacggacccaatggacgttctgcccagggcgctgctcaccagaatgactgtcctgagcacagcacagtctgactacaataggaagacactctctccggggaaggccaggcagcgtgctgcgagagatgaaaacgacacaattccgtctgtagacacttccaggtccccgtgtcatcagatgtctgtggactaccctgagtcagaagaaattctgagaagttctatggcaggaaaagctgttgctataacacagagcccatcatctgtaagacttcctcctgctgcagctgagcacagcccccagacagcagcggggatgccttctgtggcctcaccacatcctgaccctcaagaacagaagcagcaaataactctacagccgactccaggcttgccttctccccacactcatttgtttagccaccttcctttgcattcccagcagcaatcgaggacaccttataatatggttccagttggggggatccatgtggtacctgctggcctcacatactccacgtttgtgccccttcaggctggaccagtgcagctcacgatccctgctgtcagtgtcgttcacagaactttgggtactcataggaatacggtcacagaagtgtctggcactacaaaccctgctggagtggctgaattaagcagtgttgtgccatgtattcctatcggccaaatccgcgtgccaggccttcagaacctaagtaccccaggcttgcagtcactcccctcgttaagcatggaaaccgtcaatattgtaggcctagccaatacaaatatggccccacaagtccatccaccaggactggctctgaatgctgtcggactgcaggttctgactgcaaacccttcatcacaaagcagccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtttcagtaaaatattgtttactgactttaaaaatgct

SEQ ID NO: 316000 - DNA, 1012 bp, Homo sapiens
cgctgctgggcggcggcagggtggcggacggagcgggggaccggggagcggcggccgcgaggaggttatgtttgtgtttggggttgtcaagtgaaggagggatcccaggcgccgccgccgccgccgcgggggtcgcgagatcccgagccgcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagggtcttgctcttttgctcaggctggagtgcagtggtgtagttgtagctcactgcaaccccaaacttctggggacaagctaaggcttgtccccttcctgctttagcgtcccgaatagcttggactacaggcacatgccagtgtgcctagctactttttttttttggcggaggggaggggagttcctcactttgttgcccagactggtcttgaactcccagcctcaagtgaacctcctgtgttggccccccaaagcactgagattacaggcatgagccaccgcacctagtctgtggtttttcttcttcttatttttaaacatcctgtgcagaaaaaaattaaggaacctgatgtatctgttagacattaataccgtgcaaattcagtatgttttagtgttttgatctattgatatcctttctattgaaggcaaggaacaatagttattcggggctttattagattttatttaatgctttcataaagaagcacagatattactatttatcaactgtaatttttaatatttgagaactatattttggtgtaattgtttttttaatcctgtgtattttatgcattttaaaacattctgaaaaggggtccatcaatttggctaaactgcagaggcatacagggtacacag

SEQ ID NO: 316001 - DNA, 696 bp, Homo sapiens
tttaattcatgaggatctttcatattaaaattgcatcaactatttaattcatgaggatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316002 - DNA, 2741 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316003 - DNA, 2725 bp, Homo sapiens
gaatataggctagtacgaggcctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316004 - DNA, 2824 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatgtaagaaatttgaacaatgtgccatttcccagtacctagaaggctgctaaaggaagttgaatgacagggcctcggtcctttatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316005 - DNA, 3627 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatccaaaaaaaaaataaccaatacactcacacccagacacacaacaaccacacacacacaacaccacagcccaaaccaagactcaccacacacaccacaccccacccaaccacaccacaccacccacaccaccagtcaacagcacaacgccgacaacaacacaccaaaacccacactcgacgcccagcacccttaaacaaaactaaaaaataccaaacaacacaaccacacctactatctcctactcacacgtaacaaatctacatactatacactaacacaacacaatacaatactacactaatcactactacccacaccttcttcataattataaataactcaaccactatcttaacaaatccacccaacactctctcccatcgcaacaagataccaataaacatactatcaattatcaatactccccaacacacacacaccatacgaacaatatatgaagcgagaagagcaggtgaaaaagaggccacacaggaacggcgaagactagagacgcgcgaagaagatcacgaaaccaagcgcagactggcgtggtcgattacacgcctactaccacgcacgacgaatgtaagctaaggtagtaagggagtatgcggcacggcaggaggagccagggcaggagtgaacgggagattcaactgggaacatcgcgacgcactgcaagcgactgcacatcgagagacgaatcacacaacgcggcggatcggaacagcagcgagcatggagaggctaacgagcgcgtgccaaacagctagaaaccataggcgagcgaacctcagacgatcggactacacgcttacgacccagagatcatgacggaaaccaaagcaacggcagtgagccggagatcgcatgcagacaaggcaga

SEQ ID NO: 316006 - DNA, 2689 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316007 - DNA, 2720 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316008 - DNA, 2996 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatcaacaacacaaaagaccgaacaacgaaaccagcactcaccaaataggaggaccagccgaacaagataaaacacgatacacgtcgtcgaaaggtccatgacccaaaacaagcgtggccaaacaaacatcgtcaaccactgatgggcacaaacatggacgcggccggcgtcacacaaatacatcacgacaggggaccaaagaggaccacccatactaaagaaacgaagccaaaactaggtgaaaaaaaaagagaaccg

SEQ ID NO: 316009 - DNA, 2624 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316010 - DNA, 2278 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316011 - DNA, 2671 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316012 - DNA, 2224 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacctagcccagacttcggggttgagagatacttcggagggataggttggggtgtgttgtggg

SEQ ID NO: 316013 - DNA, 1802 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagt

SEQ ID NO: 316014 - DNA, 2147 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatcagcctcgtgccgaattcttgg

SEQ ID NO: 316015 - DNA, 2389 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgtgtaatagtttatgacagcataaattattccagtctgtcattgatgggcattggggctgatgccatgttttggctgttgtgaatagtgctgcatggaacatatgtgcgcaagtatctttataatagaataatttataatccttggggtatatacccagtaatgggatcgctgggtcaaatggtacaaatggtatctctgcctctaggtccttgaggaattgcacactattttcacatggttgaatatttacccccataacaggtaa

SEQ ID NO: 316016 - DNA, 788 bp, Homo sapiens
tgtgtgggtgatctagaggatcccgtatctcaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316017 - DNA, 2839 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacgtgactgaaaactcctgaggcatttcctggactagaatgggtagtgaagacccatgtcagctatcagaggactcctgaaacctggagagctacctgctgtataaaggctggcctgagggcatttgctgaacacagagaaacccaggagaggagatcagcagttttctttcactctacttgatctgtcagatttacccacagaaagccagtcaggatcccttaagagtctttaggcccagaatggagtcctcagggctgcaggggactgtggtgctaacaattaaactgttcaagactttaaagagttgaaggggactaatgggtatccctagcatggcctcctagatgggaattaactggcaactcctactgtgccattcccagtatgtgtgcttccctttagcctcccatagaattggctgaaacaccctaccaccgttttctgtttccccactaccacacctgtgttatgggtgtcagcctgtgagtccttgaacccttccagagggctcccaagggagggtgatcactgcccttccataaaaggctgaggaaagccaagtgagaagattcaattaatttgggcaagttatttaacatctgaacctgtttttctcttcattgtttattacttaccttgtccaaaaaggtcataaagggtagggctttttctgttccacctctgtactatatttctccccaacaaatatctgcccctgaggacctcaataaaggtttggtcaagtgaaaaaaaaaaaaaaaaaaaaaaaaaaaaaaaaaaaaaaaaaaaaaaaaagacaaaaacgaccaaaaacaacaggggcgggcggcgcgcccgcgcagaaaaaattcatccgccgagggaggggcccccaacgttagcggcagcagccagccagcgttcttttgttgagaaacgagggggcccccaaatgaagggagcgcgccgttataataaaaaagcgagcgtagcgcgcgcggcggcggctttataaaaaacacagctgtctgatcgggagagaaacacgcgctagatcacgcgaggggcactcatgggggaggaaaagagcccacaactatctgcggggcggggaccaaaactggcggcacaaccacccccgccgagagagtaacacgccgccccgcggggagccaatacaaaacggccggggtagtagagccgggtcaaccacgcgcgcgttagcggcgcgcgcgaggaaagcgcgcccgggggagtagtgctgtcaacagttatcccg

SEQ ID NO: 316018 - DNA, 1885 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatgtaagaaatttgaacaatgtgccatttcccagtacctagaaggctgctaaaggaagttgaatgacagggcctcggtcctttatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagt

SEQ ID NO: 316019 - DNA, 1781 bp, Homo sapiens
cgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagatgcagcgccgggacgaccccgccgcgcgcatgagccggtcttcgggccgtagcggctccatggacccctccggtgcccacccctcggtgcgtcagacgccgtctcggcagccgccgctgcctcaccggtcccggggaggcggagggggatcccgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcagaaattgagaagattcagaaaggagactcaaaaaaggatgatgaggagaattacttggatttattttctcataagaacatgaaactgaaagagcgagtgctgatacctgtcaagcagtatcccaagttcaattttgtggggaagattcttggaccacaagggaatacaatcaaaagactgcaggaagagactggtgcaaagatctctgtattgggaaagggctcaatgagagacaaagccaaggaggaagagctgcgcaaaggtggagaccccaaatatgcccacttgaatatggatctgcatgtcttcattgaagtctttggacccccatgtgaggcttatgctcttatggcccatgccatggaggaagtcaagaaatttctagtaccggatatgatggatgatatctgtcaggagcaatttctagagctgtcctacttgaatggagtacctgaaccctctcgtggacgtggggtgccagtgagaggccggggagctgcacctcctccaccacctgttcccaggggccgtggtgttggaccacctcggggggctttggtacgtggtacaccagtaaggggagccatcaccagaggtgccactgtgactcgaggcgtgccacccccacctactgtgaggggtgctccagcaccaagagcacggacagcgggcatccagaggatacctttgcctccacctcctgcaccagaaacatatgaagaatatggatatgatgatacatacgcagaacaaagttacgaaggctacgaaggctattacagccagagtcaaggggactcagaatattatgactatggacatggggaggttcaagattcttatgaagcttatggccaggacgactggaatgggaccaggccgtcgccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagt

SEQ ID NO: 316020 - DNA, 467 bp, Homo sapiens
  misc_feature (18)..(18): n is a, c, g, or t
  misc_feature (31)..(32): n is a, c, g, or t
ggtcgactcccaggattncctcttcgctgtnntgagcttgatgttagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316021 - DNA, 480 bp, Homo sapiens
tcgaactgttcccaagtgagtcaagtatgtctcaacactagcatgatataaaaagggacactgcagctgaatgaaaaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatc

SEQ ID NO: 316022 - DNA, 653 bp, Homo sapiens
aattacttggatttattttctcataagaacatgaaactgaaagagcgagtgctgatacctgtcaagcagtatcccaaggtaaggcaaaaagtgctttggatctttgagttatctttatagttatgagagagtcatgggctataataaagactcctggggattgtgatgctttagaaacttaagcctgtgaagcttctctttcatgcttgtagtacctgttactgagagttgaaatatctaagttcttaactaataacatagctatagccaggaaggaaatataatcatctttttattatcaaaaagtttctttctcaaatgattgctcaggctacaagttcaaagaaaaaaaaattaaaacctgaagagttgctctttgtcaaaagactaacctgaaatctaaataaaaggaaatataatatgaatcctcaattggttgaagttaattttattttcttactaaaagtttacttttaagtaaatgctttttttcttcctttttttttttttaggaaagcatttagttacatttagtttatccagcgtgttatcaaagggtgctatatagtctcttctgttctgaggtcactgccttaaaaatgttgatgtatgttaagtgctgggccaggcacagtggctcatgcctgtaatgc

SEQ ID NO: 316023 - DNA, 527 bp, Homo sapiens
cgcgggggcgcccgggcctcgcccgccacgcagccgccaccgctgctgccgccctcggccacgggtcccgacgcgacagtgggcgggccagcgccgaccccgctgctgcccccctcggccacagcctcggtcaagatggagccagagaacaagtacctgcccgaactcatggccgagaaggactcgctcgacccgtccttcactcacgccatgcagctgctgacggcaggtaagggggcctcccgtgtccctctgggtcgcccggccatcccgggcatgagtggccctggctttgttcctctcgcttcccgccccctcgggaccgaggcagtcgggagttccggtctcatcctcatttttgggagcctggattccacattcccacctcagcccggagtgcgtgggagaatttctaggctgcagtggaggcccgaaggcgactttgcgatcccctagcgctaatgtcttgatggatagtgctgagctccccgcccctttcccgactcttccctcctccctcctcttgc

SEQ ID NO: 316024 - DNA, 665 bp, Homo sapiens
gggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatctaaatgtgatgaattgtcatttttttgggtggaccataaaatagttttctctttcaaataaacttaaattaactctaaagttaatgggcttgttaaaagttggaaacattcttaaaagtggtgggggggattttattttaagtttaccaaaaaaaagttgatggagttgttaagttttagtttaaaaataaccaaagctttttcaccc

SEQ ID NO: 316025 - DNA, 741 bp, Homo sapiens
cgcggtggctcatgcctgtaatcctagcactttgggaggctgaggcgggcagatcacttgaggttaggggttcaaaaccagcctgaccaacatagtaaaaccccgtccctacaaaaataaaaaaataaaaaaaataagccaggtgtggtggtgggcacctgtgatctcagctacgtgggaggctgaggcaggagaatctcttgaacctaggaggcagaggttgcagtgagccaagattgtgccagcctgggcgacagggtgaggctcttgtctcaaaaaaaaaagtccacatcttcatgaaccctcagactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagtt

SEQ ID NO: 316026 - DNA, 1161 bp, Homo sapiens
cgcggtggctcatgcctgtaatcctagcactttgggaggctgaggcgggcagatcacttgaggttaggggttcaaaaccagcctgaccaacatagtaaaaccccgtccctacaaaaataaaaaaataaaaaaaataagccaggtgtggtggtgggcacctgtgatctcagctacgtgggaggctgaggcaggagaatctcttgaacctaggaggcagaggttgcagtgagccaagattgtgccagcctgggcgacagggtgaggctcttgtctcaaaaaaaaaagtccacatcttcatgaaccctcagactctggagttgggtgtcggcttttttagccagcttttgtgggaattgcctttgacctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttaaaaaaaaaaaaaaaaaaaaaaaagaaaaaaaaaaaaaaaaaaagggggggggggaaaaaaatttcccgggggggggccaaatatgaggatcttacaccgagcttttttttgtgttacaagagtggggccccaatatggaggagtgttaatatatacgacagggggcttgcgacccgtgttttaaacaaggtttgtgtatgtgggaacaaatgtggtaccggggggacacttgtgggaaagagaaccccaatatttgtggtgggggaaaccatatgtggcgaaaaattcactgaagaaattttaagggatctgaggggtatcatattaaatttaagagggtttaatgggtgtaaacacaggtcattaattgatgggggggagagagtttcgtacggggaatatatgttggagatatttgc

SEQ ID NO: 316027 - DNA, 6832 bp, Homo sapiens
  misc_feature (6740)..(6740): n is a, c, g, or t
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316028 - DNA, 6953 bp, Homo sapiens
  misc_feature (3513)..(3513): n is a, c, g, or t
  misc_feature (3562)..(3562): n is a, c, g, or t
  misc_feature (3625)..(3625): n is a, c, g, or t
  misc_feature (6861)..(6861): n is a, c, g, or t
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaaggagganaaaaaaaggagtttttttggggggggttttggggttttttaaaaggaanaaaaacccccccccccaaaaggggggggcccctttttttgggggttttttggggggggggagnaaaaaaaaggggacccccccctttttttggggaagcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316029 - DNA, 5960 bp, Homo sapiens
  misc_feature (5868)..(5868): n is a, c, g, or t
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316030 - DNA, 6778 bp, Homo sapiens
  misc_feature (6686)..(6686): n is a, c, g, or t
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggtgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316031 - DNA, 6776 bp, Homo sapiens
  misc_feature (6684)..(6684): n is a, c, g, or t
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316032 - DNA, 6845 bp, Homo sapiens
  misc_feature (6753)..(6753): n is a, c, g, or t
agctcagcatggctctcctcccagcttcactgtcagctgtgcttgaaggagaggctagcgtccaggacagcccaggctcagtcatgaaaagctatgtgtcagagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316033 - DNA, 6977 bp, Homo sapiens
  misc_feature (6885)..(6885): n is a, c, g, or t
cagatccgccatattgtctactgaaagctgccgctgaagctgccgccgttgcctccgccgccaagagtgagcgagcggacccgcgatggagattgggtcttgcttagttgcctaggctggttgcaaactcctggcctcaagcaatcctcctgcctcggcctcctaaagtgctagaattataggtatgagccatcgtgcctggccctgagagcccctttgatttcagaattccagagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctctcttctcccctagactcactcagcttggtatccatcatcttgagcattcttcagtagattcatctagggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316034 - DNA, 5469 bp, Homo sapiens
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccttgatgttggctgcagccttctgatagaaccacatggattccacccacagctggccaggcttgttacatgggtcagggaatacaaatggcccccccccagggagcaggtgttggcctcagttttcagggacccttggtgttgctccttacctagagcccattaatctaccccatcaactctctgccatgaaagccatcttccaggagccctgttttttggagctgaactgcacagattatagctgctattgtacttaaataagggagaggaaaagaaggttctcaggcacagactttctatttttctcaagccaaaccagtttaaaatgtctagcagaatgaactgtatttccatttcttcatgtctacctgccttccccccacaccctaaagttgtacttgtttctagcaaactagaaggaaaagataggaaagcctggcactactaacctcacctctcatacacctctttgaaggccccagctcttttgttcaggcctcctggaagatggctttcatggcagagagttgatggggtagattaatgggctctaggtaaggagcaacaccaagggtccctctgcaatgaacccacg

SEQ ID NO: 316035 - DNA, 4934 bp, Homo sapiens
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagtttaaaaaaaaaaaaaaaaaaaaagccttcccctacccaacctccgcccattgttctcttccaaagggcaatttagtaggatctactttgtacatctcaagtaagagttaagtccctgatacagggaccagtttcttagtgtaagacatacacatcctgcttgtccagctgttcctccaaaatctactttggcttcagctccgggtcctgtaccagatggaaaatgtttttggtgatctggctgctgcttaaagccagttttccctaagaactccaaaggctaaagtctactaggggcagagtgtgaggatagatttctaatcagagaaaagtggcctccaggagctttcatttatgtcttctccagaccaggttttcctgttatcttcctttaatcccctttcaaccaacaggtgaagttcttccagcccacagaggtagtaatatcatcttttctatctcctcctctcctttggccatgtaatgaagcaaaatattatttatttagcccaggcttgagagccactgtttgtggacagtcttcatctagattccataccctggcctaggcgaggtaaggctctctggttattgccaggatggagcccctctaccccagtctgctgtagggaataccctaattagttgaggcatgcttttggaatcctggcatgttggcatatggctggtctatcctttttaagatctctggttgggggtatctggatatggattaggagggacaaggagcctttttcttggctaatgttttccaatacttttttgaatggtgccagcccctccaggcatcccacccccaaatcatcatctttagtactaacagggtgtctggtcttagaagcctcccttcagatcccagctgaccctggtgactgcctggccagctgtgggtggaatccatgtggttctatcagaaggctgcagccaacatcaaggccaggca

SEQ ID NO: 316036 - DNA, 3974 bp, Homo sapiens
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaaggtaatcaatttgcacctttttttatttttattttttttctttttttcttcagtggtgacttccttccctttatcttttttcattcttcccggtcctctgccctgatctgtgtaactcttatcttgggtacttgagcagacggtatattccagaggtgggaggtgggaggggaagggagaaatccaaaacaaagtgttcttgctctgacagaatattaatcttgtacgcttggattgagttatttaatttttttttcttttgcacatttttcttgtattaagattgctcttcccaagagccacaagttcctggttttagtaaacccagctgcctgcattgcctgggactagaggctggggaggctaccatgaaacaaaggtccctccctccctctgactctttgcccagacctctttagtttgggggatcctcctcactctcctgaagtgtctcaagtataccagtgggagtgcaggggaggagcacaggccttcagatggggcttcccacgtgtagctactgatcccatatttcctactcaccttccaaatggtgcgacccaacttcatttgtttacttgaaaattccccctcgaggttgagagaacctctgaggtggctgtattttctcctaagcttgagatagggggctgtggtccttcctttctcctgaggagaaagtccttgctctggtgacctgtaagttgcagaggagggtggagtgagagtgtcatgtattgggatagtcagggatccctgcctttggcctttcttcttcttcttcttcctcttccatagttggatcatgtatattttacttctaaaggagagaatgtcaaaaagttctgtatttttttatattctatatattaggtaggtcaatcttaattggtctcaagaggaagaactgtctgtcatttcggtaagtaggatactgtgaggaagaccaaaaagagatatggatgcttcctcgctcaggaggcctgagcttggtccttttcctctctgcttggattctggaccaccacctgggaccaaccttcagctctggaaccttcataaagcaggtcagcgtggcctgattgtcccaggacctgaagggagcaaggatggcctcagggcctggtgaagtctgctactctgtccttactgctgaacatcctgcttgtatcaggaaactcagaagcagtttgccttgtcaaattcaatctcaatggccattgtccacataactgatcacccatggctgcctctcctattatctattatcactgaaacttagtagcctgctttttttttttttttttagagctattgcgtatcttccctgtttgggatccttgtacctggtttgggttttcccttccttgtgacaattataatccagatgcctcttctttctgtttgaattacggtagtgcattgccttagtggcttgcctgtgcctctgggtggattacatatgatagtaaagcccacctgtttggatgggagtagaggaagttggtgtagaccagctgtggagctgaaggcacagtctgccccacccccacctccccactgtggttagtcagaggcatcctgctccaagctctgcttttccttcctctgaaacaatgccattcttgcttctattgctacacatctccttctggctcaggtgaaatccatgcccttctgcttatagacctaaagttcaggtacttattattggccattgatcttgaatttgccctctcctagtgctgcagtcccacttcaaagccattttctgaggaggatggtttaggtctggcaattgtccttgaaaaatcccacccatgttgtaccaccttggtgagtcatatgccactcatcagcttgggaatgatggctgccaactcccaatctcccaggaaggcagggggcagaatctttttttcacttggcctgctacctccattaaaaaaccattctcttacagttta

SEQ ID NO: 316037 - DNA, 2196 bp, Homo sapiens
cagatccgccatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataatatctgcctccagggaggggaggggatgggaagcaccaccagccagcggaagagcagccctctggtgggcgggaaaccagtgtccccaccatcagccaccacacacctctgctgccctggagactgtgctcttgacctgctccgcccccttccctggagggagcaccctctggacagacagaaccatctgaggctcacctttgggttttgtgacaagaaggggacgtgttgggtttttcttccttacactatattttggctgcacacatgtctttaacccaggagcccaggggtagacaaaggaggactaagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagtt

SEQ ID NO: 316038 - DNA, 1442 bp, Homo sapiens
  misc_feature (1350)..(1350): n is a, c, g, or t
tagctgtctgctaccccctgggttaatgcatatcgtcgatccacgcgctcgggttcagattccagactctcagctgaagacagggagccaatttcccccaggtccctgcaggtaatccagggaccccatagggagaacaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaaaaaccccgggggcctcttattgcgggggcgcgggaaaaaggggtttgacattggaccttggtccattagcgctgtttcccgggccccaggttttcttgttcccaggggggtaaattcgggcgggctcccctatagnggaggggcgaataaattacgacaacccaggtaactgtaatcgtctggatcacacaacaccaaataaccccacataacatagaaaaacaacgt

SEQ ID NO: 316039 - DNA, 410 bp, Homo sapiens
gtgagtgaggaaaccacgcagtagggttcttgggctcagggagtgtcggggcctgggatttggcgagagcctgtctccggtctgcggaagatgtctgcatcccctctagctaggtctgaggggaaaagtcaggccgggagtgcccctcttgccagttttgggccgagctagggcccgtgctggaagcagtcctttggtgctggtttcggggacaccttggcacgcctggagccccccacatggtggcctcgggcaggagcccacgtgttcctgggaggtagaaaggggcctactctctgtcctgcgcccagactggggctgggggacgggctcccggcggcaggcctgggcggcgctaaggtagctttctcctgggttgtgtttggccaacgcgtgtcttgactagattc

SEQ ID NO: 316040 - DNA, 3759 bp, Homo sapiens
  misc_feature (16)..(16): n is a, c, g, or t
caggaactgggccagntccggtcccttccttttggggctctcactctggaggatggggtggatgggagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316041 - DNA, 559 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaagcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316042 - DNA, 458 bp, Homo sapiens
acgggaattcgtgctggtgctacgggaattcgtgctggtgctaagggacttcgtgctggtgctaagggaattcgtgctggtgctctacgaaaacaaagcggcctatgagcggcaggtcccaccacgagccgtcatcaacagtgcaggctacaaaatcctcacgtccgtggaccaatacctggagctcattggcaactccttaccaggtaaaggagcacccatcccaggccacaatgccctgcacaggcatctggagctggccaggggaggggtggccctgagcccattgctttcagccccatgtttgcggagagaccaactaggcttagagctgtggatggagacctcattgtttgcctttcgcatctccctaagtccttgagagcctcctggaagatgttcagtgaccttccctcgtaaacctgtgggtcagcactgtgttcgtcaggagttactct

SEQ ID NO: 316043 - DNA, 142 bp, Homo sapiens
tccacggttggctactagtccacggttggccactagtccacggttggctactagtccacggcctggcttgtgggaatgcagagagaaacaggccagctgagcgctctccagcccctggcctggcttgtgcctcctcaaccta

SEQ ID NO: 316044 - DNA, 3939 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316045 - DNA, 4375 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcagggtggctccacccgacggggtggggactgttgccaggaggatgctgggggcgcagctgagaagtggtggcagctgagggggtcagctaaggctcaaagaaaagcccagacttgcacctggggtctgggtgaagcccactcttcgctgtgtggcctccggagcagccttagccttgcgtctctgtgctttagtttcttctcgcgtccttggctttgctgggagggtcagaggagtgattagatgacatgtggtcagcagcctgggcctggagatagcatcacggccttgctgctttcagcaacgaggcctggaatgagtcacatcccaaccacagacccccaaggcgggatgagacgggtcttctttgagcagagtccagcacaggggcggctgtgggatcagtgctgtgtcctgacccttcccctgtggccctgtagctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316046 - DNA, 2822 bp, Homo sapiens
catccctcatccagtggatgcctcatccagtggcatgccctcatccagtggcatgccctcatccagtggcatgtcctcatccagtggcatgccctcatccagtggccctcatccagttccatgccctcatccagtgtcatgccctcatccagtggcatcccctcatccagtggcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316047 - DNA, 2825 bp, Homo sapiens
cgaggctgcctctccacagcgctgtgccactggactgcgccctccatgccttcagagcctcatgcttctgtcctgggccctcctgggtttacctttgtggccatgagcaccaggtggccatccctggtagcaggcgccagccccagggcctggacttcgaggacccaggcaaagtgtgtggggggtgctgcctggccacagggcggccctgctcagcccccgcggccccggcccctgcagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316048 - DNA, 2491 bp, Homo sapiens
  misc_feature (39)..(39): n is a, c, g, or t
  misc_feature (41)..(41): n is a, c, g, or t
cagagttcttatggatagtcccatcacctccaaagcagngngcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316049 - DNA, 2488 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacacgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316050 - DNA, 3911 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316051 - DNA, 3903 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggggtgctgggtggagagatgagatttagggggtgcctcatggggtgggcaggcctggggtgaaatgagaaaggtcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316052 - DNA, 925 bp, Homo sapiens
tgactagtacgaggctgggtgtgtgaatcggccgagggtccctccttccccaggatgggggtccccatcccccaggatgggggggaggggacccccatcctgggggatgctgggagtgagtgagtggagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316053 - DNA, 3187 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaagggttcccatcatccctccctgatattgtattgaaaatattatgcacactgttcatgcttctactaatcaataaacgctttatttaaaag

SEQ ID NO: 316054 - DNA, 3423 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtggagatggctgagtgagggttatggggagcctgaggttttatgggcctgtgtatccccttctcccggccccagcctgcctccctcctgcccgcctggcccacagcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316055 - DNA, 3358 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaatcccagccctgcatcctccgtgccgtagacctgctccccagaggaggggccttgacccacaggacgtgtggtggcgcctggcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316056 - DNA, 2825 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatcactcagggacccccagctgccccagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316057 - DNA, 2146 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagggtctcgaacgtatacacggcattgtccatttgctcccgcatgtggatctgggctcgctgcttgaacacggacgtgctggacacatcaaatcgctgctgcagcccgtccagtcgcagcgactccatcttctcatacagctctgcatcttcaggggctgtactacacccgggacagaa

SEQ ID NO: 316058 - DNA, 1992 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccacagagagaaagggttaagtgagtcactgcaagttagctccctccccccacagagagagctcgggatcctt

SEQ ID NO: 316059 - DNA, 1869 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcgaaccacgaggaggagatgaatgccctgagaggccaggtgggtggagatgtcaatgtggagatggacgctgcacctggcgtggacctgagccgcattctgaacgagatgcgtgaccgttgagatcagcatgtccc

SEQ ID NO: 316060 - DNA, 1883 bp, Homo sapiens
  misc_feature (1849)..(1849): n is a, c, g, or t
  misc_feature (1860)..(1860): n is a, c, g, or t
  misc_feature (1870)..(1870): n is a, c, g, or t
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggaggtagacccgaggctacgacccccaccccacaccctgtccactgccttccacaggccccctcgcccagggggtcccttctgctccgtcccgtcatgccatagccacgcttgcctggcacgctctctcctcctctgcttggaacatctgtgcctctgcccacctggctaattctgactcacttcccaggtctcagcttagagacctcttcctccaggaagctctccttgcgctcccaggccccttcccatatttcctgttgccttgaggcagggacttgctccagcgtgcagagctgtgagtgggcatagaccgcttgccattcctcagggccaatggagnccactgacctncacagggtcntcccagtcctgtc

SEQ ID NO: 316061 - DNA, 1612 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgaggtgaggccggcaccgcccctaggagggggtctcctgagagtaggtctggtctgtcccagagggccccggctgcgtgactccgggcagccgttcccctccaaggccgtccctgtagacggggaggggctgctggggactaggggcagaggctgtgaggccagggctgttggagtcctcgtggggcctgcagtttgaggaaagagggaacattagctcccggccaccagcctttagaaaccaagagtggtgctaaaatag

SEQ ID NO: 316062 - DNA, 546 bp, Homo sapiens
gccaaggcggccggctggagggacggggcccgaccgggagcggagccggagcggaagccgcagccgggcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcaggtcagaggagcaccagcctatggccctggacccctggggtattcagcgagttcctggaggacggtgggatggggctgtggttccagcaagaaaaaaccgggaagatcctgacggagttcctccagttctatgaagaccagtatggcctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaaag

SEQ ID NO: 316063 - DNA, 949 bp, Homo sapiens
cgggggacgtctcccgcgggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316064 - DNA, 1332 bp, Homo sapiens
gtccggactggctgatcgcccgacgtccgggcctccgagtcgccgactcccggaagccgcctcgagccgcgctgaaagttgcctggagcatccgggccttttggacgtggacacgtttgttccaactttcggctgtgaatgtcctgtcgagcaagctctggtaccagcctcgccagtattcagtcgcttatctaacttagggtcctaagcgttggtgttttatccacttagccagcctcttgcctgtttaagcgaccgctgggccggcagtaaggagatatgacgagaaaaagtatggtggagactactggattaactatctaaccacaagagacgtgatccgctcttaacatacaggtgctcctggatttaccatgggattgcgttccgataaacccatcatgaatcgaaaatgcctttaataccccgataaacccatcatctaagttgaaaatttgtaagtcggtgactgttcttgaagacacaattctgatataaggaaaaagatgttttgattttttccttaaggttgcatgccttccctaatcaatcgttaggttaaaagcaaaacatttaatttcagctttaattgccaccttggcacgtactaatttccagtgagttggctgtagtttagactaaatggaatgttttcagacgtttgaaggataattcttactttgaaaacctaaagactcagcatctggcttaatctactctttagttatcttggcattcttcagtgccatacaaagttaacatgactttatgttttcaatgataaacccctaagtttgtcatagatgtttttaatgccacttttttcaaacgctatttaaaatgtttctcttttccaggatggagtctatcttgtaaaatgtcctcttcacacatggtagaatctcctgtgttgtttggatgaggaggctatatttctagcaaaattttaagccaaaatctaccagttatagtcactccagaaacatttagtgggggtcaactataggtcagtttctggagacttaaacatgggtaaaatttggatattatccttaaggaactcacggtatgatcttggcgaatgaatagaccagctctatcggaacaagagactcttctgagtttagggtgaagaactaacacatgtaggatcggggcatcattaatttctccttttcatatttgcatgtggcatgacttctgtcttgtaaaagtctatctccttatatttctgctataagcaaccacatttcaatctattgggctatactataaaggtcatggttttaattcagaaaagttgattatttaatctaggttacttgtgttttc

SEQ ID NO: 316065 - DNA, 7048 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316066 - DNA, 4745 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316067 - DNA, 6991 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcacagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316068 - DNA, 7205 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316069 - DNA, 960 bp, Homo sapiens
aaaaaaaacaacaaacacaaaagaacacggcgaggatgaggaagtgcggcttaatcggccgaggagacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316070 - DNA, 7854 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316071 - DNA, 1158 bp, Homo sapiens
  misc_feature (1156)..(1156): n is a, c, g, or t
cgggggacgtctcccgcgggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcaaacaaacaaaaaaaaaaaaaaaaaaaaaaaaccagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagccacgtncg

SEQ ID NO: 316072 - DNA, 9075 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaagaattgtcttgggtcacaaataaaatacactaatgatagctgataactttttttttaattgcaaaaaaaatctcataatgttttaagcaagttgatgaatttgtgttgggctgcaggttggacaagcttttgctttacatatttcacatgtccactggggtttcttttggttttgcttgttggttttagggcatttcattatgtcttgggatcgctggcatcctcccttcgggacactggcagaatcaggcccagcggtcacatctctctgatcctacatttaaatgtacgacaggtcacagagcagagaaaatcaagacgtcagaatcgaaccgattgagttctgagtctggagaggttctcatccctcttctgttaaacatggactagtaaatagatgggtggcgattgttttattgtcagcattcaagaagcataagagaaaaacaggcctgctctccccagcccaaaaacctgatggacacagtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaagttgcacatttttttctcctgaaacttttcacacctgaaatcagggtgtgtctcagtcacggcgtgcagtctcttcagcagtgtttttccttatcagtgccgttggcttgaggagctgcgcgtgttgagagagtgggtgtggttctgtgctgcgtgccgtggtttggatggcacggttttctttattttccttggttgcaggcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316073 - DNA, 1027 bp, Homo sapiens
aaaaaaaacaacaaacacaaaagaacacggcgaggatgaggaagtgcggcttaatcggccgaggagacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316074 - DNA, 1281 bp, Homo sapiens
gtccggactggctgatcgcccgacgtccgggcctccgagtcgccgactcccggaagccgcctcgagccgcgctgaaagttgcctggagcatccgggccttttggacgtggacacgtttgttccaactttcggctgtgaatgtcctgtcgagcaagctctggtaccagcctcgccagtattcagtcgcttatctaacttagggtcctaagcgttggtgttttatccacttagccagcctcttgcctgtttaagcgaccgctgggccggcagtaaggagatatgacgagaaaaagtatggtggagactactggattaactatctaaccacaagagacgtgatccgctcttaacatacaggtgctcctggatttaccatgggattgcgttccgataaacccatcatgaatcgaaaatgcctttaataccccgataaacccatcatctaagttgaaaatttagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316075 - DNA, 2370 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316076 - DNA, 5928 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaaaaaaaaaaagataaaaagagttttgagcaagctcaaagacccgtgtgccagcagtcagatgcccacgttgggtgcacaggctaaggcagccggcccaatctggaaaccagtcaggcttttgccagcccctaatctagctgattggaacatgtttgttgatacaccagctctgtgatttctcaggtttagagaactctagaatttgatagagtgggccgggggcagtggctcatgcctgtaatctcagcactttgggaggctgaggtaagcagatcacgtgaggtcaggaggttgagaccagcctggccaacatggtgaaaccccgtctctactaaaaatacaaaaattagccaggcatggtggtgcgcgcctgtagtcccacctacttgggaggctgaggaaggagaattgcttgaacctaggaagtggaggttgcagtgagccaagatcacgccactgcactccagcctggagtggacagagactccatctc

SEQ ID NO: 316077 - DNA, 842 bp, Homo sapiens
agcacctgtctccatgacgacatgctctcggtttattgtgcaaccgagagcatctgtctccatgacgacatgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316078 - DNA, 960 bp, Homo sapiens
aaaaaaaacaacaaacacaaaagaacacggcgaggatgaggaagtgcggcttaatcggccgaggagacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316079 - DNA, 920 bp, Homo sapiens
cgggggacgtctcccgcgggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagcactgaatctcaactgaagcacttgccagaggcagccggtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316080 - DNA, 7505 bp, Homo sapiens
tctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatggggtgagtgaggagtggccagtgacgtgactgagcacag

SEQ ID NO: 316081 - DNA, 870 bp, Homo sapiens
gaatgaaaaattttatcatcactcctgttcaccccgcagagtctgcggagtgctaaagggcacaccaataaggatccgagggagggggtctacatctgctttttcagcccccaaagccatatattggggtggcccaatataaagctactcattagtttggttcctgagcagacctgctaataaacctcaaaaacacaaaagtctacttcactagccagactcgtgccgaattcggcacgaggttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316082 - DNA, 2170 bp, Homo sapiens
cgggggacgtctcccgcgggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccattgccctcttgaacatttaccgtaaccctcaaaactcttcccagtctgctgacggtttgcgctgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaagaattgtcttgggtcacaaataaaatacactaatgatagctgataactttttttttaattgcaaaaaaaatctcataatgttttaagcaagttgatgaatttgtgttgggctgcaggttggacaagcttttgctttacatatttcacatgtccactggggtttcttttggttttgcttgttggttttagggcatttcattatgtcttgggatcgctggcatcctcccttcgggacactggcagaatcaggcccagcggtcacatctctctgatcctacatttaaatgtacgacaggtcacagagcagagaaaatcaagacgtcagaatcgaaccgattgagttctgagtctggagaggttctcatccctcttctgttaaacatggactagtaaatagatgggtggcgattgttttattgtcagcattcaagaagcataagagaaaaacaggcctgctctccccagcccaaaaacctgatggacacagtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaagttgcacatttttttctcctgaaacttttcacacctgaaatcagggtgtgtctcagtcacggcgtgcagtctcttcagcagtgtttttccttatcagtgccgttggcttgaggagctgcgcgtgttgagagagtgggtgtggttctgtgctgcgtgccgtggtttggatggcacggttttctttattttccttggttgcaggcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316083 - DNA, 2170 bp, Homo sapiens
cgggggacgtctcccgcgggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaacagtgcacagacggctgacggctcacactgtgccgtgagcgatgtggagatgcaggaacactatgatgagttttttgaggaggtttttacagaaatggaggagaagtatggggaagtagaggagatgaacgtctgtgacaacctgggagaccacctggtggggaacgtgtacgtcaagtttcgccgtgaggaagatgcggaaaaggctgtgattgacttgaataaccgttggtttaatggacagccgatccacgccgagctgtcacccgtgacggacttcagagaagcctgctgccgtcagtatgagatgggagaatgcacacgaggcggcttctgcaacttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaagaattgtcttgggtcacaaataaaatacactaatgatagctgataactttttttttaattgcaaaaaaaatctcataatgttttaagcaagttgatgaatttgtgttgggctgcaggttggacaagcttttgctttacatatttcacatgtccactggggtttcttttggttttgcttgttggttttagggcatttcattatgtcttgggatcgctggcatcctcccttcgggacactggcagaatcaggcccagcggtcacatctctctgatcctacatttaaatgtacgacaggtcacagagcagagaaaatcaagacgtcagaatcgaaccgattgagttctgagtctggagaggttctcatccctcttctgttaaacatggactagtaaatagatgggtggcgattgttttattgtcagcattcaagaagcataagagaaaaacaggcctgctctccccagcccaaaaacctgatggacacagtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaagttgcacatttttttctcctgaaacttttcacacctgaaatcagggtgtgtctcagtcacggcgtgcagtctcttcagcagtgtttttccttatcagtgccgttggcttgaggagctgcgcgtgttgagagagtgggtgtggttctgtgctgcgtgccgtggtttggatggcacggttttctttattttccttggttgcaggcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaacatacaaagatgggtttctgaataaaatttgtagtgataacagta

SEQ ID NO: 316084 - DNA, 941 bp, Homo sapiens
aaaaaaaacaacaaacacaaaagaacacggcgaggatgaggaagtgcggcttaatcggccgaggagacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccaggtttgtttgcctttttttcatgtaaattataaaaacttcatgttcttttcaaagacagttaatttctacatattaagcaagtcattttttctctcgtagttgtattttccatttgtgttcataagtgtgttcttttatttaaataatagtgaggcaggtgatcgacttccagtggaaggtctgagaccaccactccttgtttttatcattagagaaactttaaaaatcagtttttgatgtttgtgtgttggctgtgcctgatatttgctgccctgccatcttccctaccccctctgatagacatgggtccagagggggtggccgtgccagccttgggttagcctcctccaggcaccagtggacacggagtgggctttctgctctttgctgtctccagacagtagaggtgagccaccttccaagttagcgtgattgtcaccaggcccatcatgctgctcgagcttctctggctgcgtcctcactttcacatccctagctgaggaaacagcgagtcgcatcacgtcatggaaacatgaaaaattaagctgaaaggtagaaaatgggccgtaaattgctcttagcgggtctgtttggttaattgaggagtgcctgttatcttgggcttagatccgctctgagttcagttcaatcaaaagttgtgagttttgatagttttatttttggttagttgaagaaaaggcaaaggttggtacacta

SEQ ID NO: 316085 - DNA, 1101 bp, Homo sapiens
aagcgcctgctgtgagttttattaatggcacttttctaaaacttcattaatttcaattatgagaatttgatatctggtgtaattcattgagctgctagtttgatttgctctagctcgttttaaaaagctctgtcaggcaacaggatatggatgggagtgggtcaggtgagtgaaaacgttttaagcactcctttcttcagaaaacacctctgtacccacatggggtgtgctcctcaggagtcattcagacaggtccaggagaacttgtcccccagggtgctccgtccagatacaattttaaatactgcactttcgcattttggtattttcaatggacttgacacccaataattctgaataaaggtaggaaagagggagatgattaacttttacaagtacctactatgtgccaggcactatgctacacattcttcatattttatctcaacattatcaaccaagtaggtattaagttctcacctattgatgaggaatctgaggctaagaacaatctagtaacttcttcagtgtcacccagctaataagtgactgggatttcagcctgtgtttgtctttttccagtctatgtttgttcctttatactactttgttcttaaatttcatctcttctcttaaaagaggtcaactttgggagaaggtagataatatataaacattgaaagaaaaagattatataatcatttgccagaaataaatctgaaaatattgggctggacacggtggcccacacctgcaatcccagcactttcagaggctaaggcaggaaaatcatttgaaccaaaaaaaaaaaaaaaaaaaaaagtagtgaaaatgtatggtttattaatgtaatcagcttgttattattagcatgcgtacttaatagccacaaaataaagcttaccagagatggtgtatttcggtccttgtgaaatatcttgggattggcattagaggtgacaggttagcaaggaatttgataatggcttgagagattccaataagcactacactctctgactcagaatgttctacttagaacacaaagaaagcttacgattgctcagcgcttgttcttccatgatgttgaaagttgcaaac

SEQ ID NO: 316086 - DNA, 999 bp, Homo sapiens
  misc_feature (848)..(848): n is a, c, g, or t
  misc_feature (856)..(856): n is a, c, g, or t
  misc_feature (864)..(864): n is a, c, g, or t
  misc_feature (866)..(866): n is a, c, g, or t
  misc_feature (876)..(876): n is a, c, g, or t
  misc_feature (879)..(879): n is a, c, g, or t
gggcaagcgccccggggggggaggttagggaccagcagctgtcgcgccgctctcagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagtcgtcccggtttagtgccngttgactnaatggggngnccaagatccntgnacacggtggccccagtttaagaaaaaggccctcacaggagccacctcccaagtgggtttgcgcgaaatctcgcgcaatgtgaccccccggaaaaatgcccaaaacgcgaaatattgggga

SEQ ID NO: 316087 - DNA, 2554 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316088 - DNA, 2957 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaaaag

SEQ ID NO: 316089 - DNA, 2149 bp, Homo sapiens
  misc_feature (2121)..(2121): n is a, c, g, or t
  misc_feature (2133)..(2133): n is a, c, g, or t
  misc_feature (2144)..(2144): n is a, c, g, or t
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggaaatttgcgggggatcctgggagantcccaagagcgnggcgaagcttnccttt

SEQ ID NO: 316090 - DNA, 2676 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316091 - DNA, 2593 bp, Homo sapiens
aactaggctagtacgaggctggtgtggaatcggccgagggtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316092 - DNA, 2606 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316093 - DNA, 2522 bp, Homo sapiens
aactaggctagtacgaggctggtgtggaatcggccgagggtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316094 - DNA, 2645 bp, Homo sapiens
aactaggctagtacgaggctggtgtggaatcggccgagggtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316095 - DNA, 2574 bp, Homo sapiens
aactaggctagtacgaggctggtgtggaatcggccgagggtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316096 - DNA, 2370 bp, Homo sapiens
taaaaaaattgtaaaaaaacagcggtacggtccggaatcccgggagagcaacgcaggggaggggacacactgtcgccgcgctctggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316097 - DNA, 3105 bp, Homo sapiens
ctttctcaggtattttttccatttctacatgttgaataaaagaccatacctgatctaagagtcaccccaaaggaattgcaaagtgttggtttaggagttaaaagactttgtgttctaaactcaagcccattaatagccatgtgaccacagcaaattggaactctgagcttctgttcccttatttgtaaaatacttgcttgctctgtgtgcctcacagagctgttgaaaatcccaaataagatcataaatgtcagagtactttgaagactgtgaaacattgaatactgcttatgagggagtggttatatagcttaaagcatttaactggaaaggaccttggaaatccttttaaaggaggatgggggtggaaatgcacaggttgcttctctctctctctctctttttttttttttttgagacggtcacccaggctgtagtgcagtggcgtgatctcggctcactgtggcctccacctcccaagtagctgggattacaggcttgcgccatcatgcagggctaatttttgtatttttagtagagacgaggtttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316098 - DNA, 2565 bp, Homo sapiens
gggcaagcgccccggggggggaggttagggaccagcagctgtcgcgccgctctcatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316099 - DNA, 2785 bp, Homo sapiens
aattgtgactaggtgactactttacattagatagtcttctctgatgttaacatttaaatttaggacctcggctgggtgcggtggctcacgcctgtaatctcagcactttgggaggccgaggagggtggatcacctgaggtcgagagttcaagaccagcctgactaacatggagaaaccccgtctctgctaaaaatacacaattagtcaggtgtggtggggcatgcctgtaatcccagctactcgggaggcttaggcaggagaatcacttgaacccaggaaaggcggaggttgcggtgagccaagatcgcaccactgcactcccgtctgggcaacaagagcgaaactatcaggaaaaaaaaaaaaaattttaggacctcagtggtaaggagccactcaaacaatgtggagacaaaatttccagcctctatcaggtcaaacaatagttaggatcgtatcttaataatctaataaagttttcttgcttcttggatctgaccaggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316100 - DNA, 2777 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgagattcttatcaagagttgaggcctatggtttgtcttgctggagtaattgtgaaataagaagaaggaactacaggtcattaactttgcctctgggcttatgactgcgtttaagggatgacttgcatcttgaaggttaaaagaaatctgggtcattaaggatgttcctaagctgtctttctcatcttactgttaggaacagcaagagtggggagctaattctcaaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316101 - DNA, 2458 bp, Homo sapiens
ttgacttgtaactatgaacctgttggttaagcaagcaggctgttccggtcggaatcccgggcgttgtggatccaagctgtcggtcaagcgcaggcggacggtgaccatcagctgtcgccgacggatctcaggtatgaagagtgaagagcagattatcattgatggacctccttgtacgtatagagagaatcgtcgctagaaacacgtacaatatgtgtgacgagtgtcagagagagttgccagagtctcatccgaccatccggacagctaatgtcgagctggcccgctgtaggctagagagtgggagctactacacatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316102 - DNA, 2281 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316103 - DNA, 2100 bp, Homo sapiens
gaagctgactatgaccagttcagtttgagcggcgctggtgacaccaaggtatggatagaagtgtagatcattggtgttcagtagactgttttctcatagggtagaatctcgtgtgttcatgattaatgtgtggattcttatcaataataaatgctccgtgtgtgcataacagatgggtgtcatgaagtaaactacaagattggtatgtgatgagcgtcataactgtgagtcgtatcaaagtagtgagttgcatgacaggagacgtactagtatcaatataatgcacgcgctgatcatccacacagttttgggtgagggtatttagacatatatgtttttactcagaaaactgaggaaaagaaaggtgaaaaaatcgaagagttgttttgctgttatgtttaagaaaacaaagatggaacatgtgatggacgaaaaggctattataatcaagccgggcaaagaaattttccattaatgttaggttttaaatgatacaaagttctctcctcactagagcttaaaatcatgaaaatagtttagtttagggattttgttctgttggaatgtttctcatattcagtttttctggcatagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316104 - DNA, 1780 bp, Homo sapiens
gaagggcagaccattgagttgccctgttgacgtgaagcagactgatgcctcactgtaattgtaagtggtgaaggtttaagaacaactttcatcacagtcaggaggagagtaaacttcaggatgcagatctaccctgtaattgccatttttctaataggtagactttagaactctaatggcagctttccaagttactttagctgtttacatttcaagcttaaacatctaaccttcagaaatggttatgttttatcattgcagtagtagcttttcatggtctgtgcagttctattcaagtatctagttaatatgatggtacagctaaagaaaacagcttcagtagtggtcagcccagaactattgctgctctgatgacagcagtgcttgtgttttacagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgta

SEQ ID NO: 316105 - DNA, 1905 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaaggtaagataagaatagaaaaataatcaggactaggagttattgtgacttcttgtgtttcatgaacaggattctatgttgcattgtgggtaaaatgagcatatatcttggtttggccaagacggtcctggtttacacatattattccaacacaattattaatagcacactttttattctcaaaagtgtcctgttttgaatagtaaactatatgatcacctaactatgggaaagaaggataagtttgacttctacctctcctcttttttccatctcaaatttaaccacagtgatagtaaagattcaaataatactaacatttggattgtgctttataatttacaaaatgtttttgagtttattaatgtatttaaactttatcagtaaaacagccctttgtatccatgtggactcaaccaatctcagatcacaaatatttgagaaaaaagaaacaagaggccaggcacagtggctcatgcctgtaatcccagcacttatcggaggccgaggcaggtggatcacctgagctcaggagtttgagaccagcctgggcaacgtggcgaaaccccatctctactaaaaaatacaagaattagctaggcatgatggtgcacacttgtagtcccagctactcaggaggctgaggcaagaggatcgcttgaacccaggaggcagagtttgcagtgagctgagatcgtgccactccagcctgggcaacagagcaagactctgtctcc

SEQ ID NO: 316106 - DNA, 1340 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagccgcaccacagaggaggctctccatgccagccacggcttcattgtggtacacgtaggccctgtgcccttccggcccaacctggaatcccttgccccgttccccactggggaacgggaactaaaatcgtctctggcaagaccaaaaataaacaactataacataaatagaacacacaagaacaaaaaaagatacataaaaacacaaagatatatatatatcgacaaaacacaaatgacatctgggggtacgcactctaaatatact

SEQ ID NO: 316107 - DNA, 937 bp, Homo sapiens
gaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggcaagggtttcctgataaaggtactctttggagggaggtggcaatctggacatttggcgatcctagtgggaggctgatcggtggcaatttagagggggaaacggcacaaggtgtgtcgggaaagcaaggttaaggtcgtatgcggcggagggaggggctggttgggcc

SEQ ID NO: 316108 - DNA, 1130 bp, Homo sapiens
  misc_feature (979)..(979): n is a, c, g, or t
  misc_feature (987)..(987): n is a, c, g, or t
  misc_feature (995)..(995): n is a, c, g, or t
  misc_feature (997)..(997): n is a, c, g, or t
  misc_feature (1007)..(1007): n is a, c, g, or t
  misc_feature (1010)..(1010): n is a, c, g, or t
aactaggctagtacgaggctggtgtggaatcggccgagggtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagtcgtcccggtttagtgccngttgactnaatggggngnccaagatccntgnacacggtggccccagtttaagaaaaaggccctcacaggagccacctcccaagtgggtttgcgcgaaatctcgcgcaatgtgaccccccggaaaaatgcccaaaacgcgaaatattgggga

SEQ ID NO: 316109 - DNA, 282 bp, Homo sapiens
gaaaaagagatttgtggggctctcttcctattgtcctgagatggtatagaataagtctgattgtgacagaaaaggagttacttgatccggggctaaagccttgatttgtggaggtggtttcaagataatatgattaatattagtatctgaatgtactacagcagttaggtaaaagtcgtctatctgctggcaaaaaaattcctggtaacaaaagcttggcttgtgtttccttgtctttcacagtgagtgttgtgcaagattctgtcaacatttctggccaga

SEQ ID NO: 316110 - DNA, 684 bp, Homo sapiens
gggaggtggaggttgcagtgggctgagatcgctccactgcactccagcctggctaacagagctgagatttcatctcaaaaaaaaggagaaccagcttggatttttctgacttccatttctaagtataatatttttttgagagatgactaagaaatagagcattcagagctagtgagataaaggaatggtaatttttttgtttgttttttttgagagagtatcactctgtcacccagactggagtgcggtggcatgattttgaggtcaccggaatctctgccctgccctgcgtgtccctcctccaccgggttcaagcaattcttgtgcctcagcctcctaagtaactgggactacagtcgtgcaccaccatgcctggctaattttttgtatttttggttgaggcaggatttcaccatgatgccaggctggtcttgaacttctggcctcaagtgatccacccaccttggcctaagaatggtaattttgactagtaaatttttactagtcatttcttctttcatatatcacctgcttttgtgagatttttcctttttaggaatagacaaagtaagtaaagacttgtatgagattcagaatctagttaagtctgattcatattctctatttccaacaagatttcctgttagacaagacaaattagagttttcctactgacttaacttg

SEQ ID NO: 316111 - DNA, 4099 bp, Homo sapiens
actaggtcgagcggcctggttttatcggcgagggcagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaaaaaaaaaaaaaaaaaaaaaaaacaaaaaaaaaaaaaaaaatgcgcaaaaaaacaaaaaaaaaaaaaaacaaagtagtgtggggggcgacgcgccgcgcagaaagacgttacaacacaacgagggggggggggggggcaccaagtagtagtaaaaaacacggtggacgtaaagaggttgttcaaccaagaagacacgcgtcgtgagcacaaacaatacgggggggggtgctccccccaagaataaaaaagcacgcgggggggggagacaaggcggtgtttgagaagaccaccccggggggagggcctggagagcggcaagagggatactaaaaaaagggaggcgtgaaaggggtgttaataaatcgg

SEQ ID NO: 316112 - DNA, 972 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagtgaaaatttggcagaatgcctagaaaaaaacaggtggacattgagccacaagttacattctggaggttaattaaagcctgggttaaccaaaaagaagtacgggaaactcctggggttgaagatgactgttgcgactcggaattatattcaacccgtggaagtgaagaatccgatcccaaatggtgcgatcaccgatgggtttgacgggcacatgtccgcaatttggggaatggcgccccggtaagccgcaaaacggggcc

SEQ ID NO: 316113 - DNA, 678 bp, Homo sapiens
agaatagatagaggattatggggctttagccaccctctgggaaacataggtaatgtaaattggatatatgttagttgaatcaaccagcaatctaagtggtatatttgaaattcataacctggttgtacagtgtagttggtggttttctcatgtgaagagagatggctgttctcaatgctgaatgttttttcctttttgtctagggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggaggtggaaagaaaaagaagaaaaagaaggacaagaaacacaaaaaggataagaagcacaagaagcaca

SEQ ID NO: 316114 - DNA, 542 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaaggtactaatatacaaatggctcttgtttctgaatatgtgatataatttgtgaatctttggaaactgaattttttctatggag

SEQ ID NO: 316115 - DNA, 3965 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316116 - DNA, 3805 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316117 - DNA, 4517 bp, Homo sapiens
agatagattttattggagaaatgctttactgatgtgtattttagtgcattttaaaaacctaagtatctggtagtattccccttgtagtgagcatgagattaaagtttagaactttttaagacaattctttttttgtggttgtgtactcattattgcttgttcgtcttttgcaatttagataaatgatataacattaaactcaaggtggttgagttgcagtagggagtcggaagcaagccaagggaacatctttctctacaggggacttggcgattccaaacccccaaggttccaagaagaaactgaagacacctggaatctgtacttgctttgtgctattgagctgtgcttgttatacagaccttgttgcttgaccaacggatttagcatttaaaaacccaattatttttgagaaatcttgacctcttagcactttgtggacagttgagaatttgaggcattgttataatagattttccttatataaaactcaggcctttagcttagccctcagaagttacagactgcatgcataacttgttagttttcataactggacaatagatattttatgcaaagctatctgtagtgttagggagcagtttatgtactttttccgtttctcattgggggaaaatttccaggcaagcaaatacttttcttgttagtaaatactagaatttgtggatgtttcatgatggtttttaaagttaataaatgtaaggcccactaacagccacagagtctaaaaatacttacgaaatccacaaaggattaacaggctgctctgatgcttttggtagagtgagagagaatttggtaatctgttagagattatattgctgagaagctactagggaagactatttgtaaaatagtaaggactatatatatgtctaagcccctatggtagacttaaaaaatactaatttaaatgagttttaggttggttgatttgttggttggttggttttgaagtaacctgtttttcttcctgtcgtgtctttttgcagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316118 - DNA, 3902 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcaccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316119 - DNA, 3666 bp, Homo sapiens
cggcacgaggtttgtcctaaacccgtgtttgccttccatcatgctaacttcccacaatatgtaatggatgtgttgatggatcagcactttacagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316120 - DNA, 3788 bp, Homo sapiens
  misc_feature (48)..(48): n is a, c, g, or t
  misc_feature (65)..(65): n is a, c, g, or t
cggacgcgtgggtcgacccacgcgtccggttctagatcgcgagcggcnagatggacgcgggattnttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316121 - DNA, 4095 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaaggcctgaaccaaaatggaagttattccttgcgtctgaagtatagcaccatcaccttattaggtcacagcagagtgagtgtcccaatgtcgctctgacccaactcccttgatgatgcagtgtgtgtttggagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316122 - DNA, 3781 bp, Homo sapiens
gaaaaatcccgcgtccatcttgccgcctcgctcggagatcgctccctatcccagggtacaccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316123 - DNA, 3907 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgattttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316124 - DNA, 3533 bp, Homo sapiens
ggagaagaccctatgaagaacagcagatggaattatagaggtatttgccctagagaaaaggcaagtccacggagtcatgattcctgttctcaaatagtctgaagacgtcacagggcagagggagcacagactgtgaagtctctgacagcagagctggtcccaacagggagggaagaagaagaagaatttccaggaggcagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316125 - DNA, 3875 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316126 - DNA, 4427 bp, Homo sapiens
agatagattttattggagaaatgctttactgatgtgtattttagtgcattttaaaaacctaagtatctggtagtattccccttgtagtgagcatgagattaaagtttagaactttttaagacaattctttttttgtggttgtgtactcattattgcttgttcgtcttttgcaatttagataaatgatataacattaaactcaaggtggttgagttgcagtagggagtcggaagcaagccaagggaacatctttctctacaggggacttggcgattccaaacccccaaggttccaagaagaaactgaagacacctggaatctgtacttgctttgtgctattgagctgtgcttgttatacagaccttgttgcttgaccaacggatttagcatttaaaaacccaattatttttgagaaatcttgacctcttagcactttgtggacagttgagaatttgaggcattgttataatagattttccttatataaaactcaggcctttagcttagccctcagaagttacagactgcatgcataacttgttagttttcataactggacaatagatattttatgcaaagctatctgtagtgttagggagcagtttatgtactttttccgtttctcattgggggaaaatttccaggcaagcaaatacttttcttgttagtaaatactagaatttgtggatgtttcatgatggtttttaaagttaataaatgtaaggcccactaacagccacagagtctaaaaatacttacgaaatccacaaaggattaacaggctgctctgatgcttttggtagagtgagagagaatttggtaatctgttagagattatattgctgagaagctactagggaagactatttgtaaaatagtaaggactatatatatgtctaagcccctatggtagacttaaaaaatactaatttaaatgagttttaggttggttgatttgttggttggttggttttgaagtaacctgtttttcttcctgtcgtgtctttttgcagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316127 - DNA, 3828 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316128 - DNA, 3371 bp, Homo sapiens
cacacaaattagccgggcatggttggcacatgcctatagtcccagctactcaggaggatcacttgagcctgggaggttgaagctgcagtgagccaaaatcatgccagtacactccagcctgagtgacaagagtgagaccctgtctcagaagaagaaaagaaaatgtacatggttggaattattagttgctctctgggtttcagtgataggtacatacatacttatgtgtcttttggagatagagacaagtctgtgaattttgaaaagttttagaaatactttattacatcattgtgtaatgatttagaaggctgagtacaagaaggcaaaaaaaaaaaaaaagcttttgtttccacagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316129 - DNA, 3447 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccataattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316130 - DNA, 2907 bp, Homo sapiens
ggtgactacgatcttgatcgggatctatgtgcgccgtctaggtcgagtgtgagaaggagagcgggaccgcgtccgggatcttgatttagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316131 - DNA, 2209 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaagctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316132 - DNA, 2948 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggaggtggaaagaaaaagaagaaaaagaaggacaagaaacacaaaaaggataagaagcacaagaagcaca

SEQ ID NO: 316133 - DNA, 2900 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggtatttatgaactctgtatat

SEQ ID NO: 316134 - DNA, 2700 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaaccttaggaacgcaatcagaattaaagtatcttcttgaaaaacaagaacaagaaa

SEQ ID NO: 316135 - DNA, 2709 bp, Homo sapiens
  misc_feature (2700)..(2700): n is a, c, g, or t
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcctgatctgaatttcttggcggtgatgggctcggtgttgggcttttggcctttttgaccggtacagctggtgaccagtttgtagacggtgacttgaagacttggaacctccgttgcccgaatttcnatgcaagct

SEQ ID NO: 316136 - DNA, 2680 bp, Homo sapiens
  misc_feature (2667)..(2667): n is a, c, g, or t
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtagtcagcagcatgagtgcataagagggccgtaacctcttcccccttgtcccaaactcaaagtgctgggatgcagaaaggaccacaaatagctgtaccttgtttgaacattagtgtattaatccagctgggtagccattatttgtttcaaaacagaatttagagccatcctagaagctgagaatggtattttcgaaggtagcccagttgactaaaattgttctgtgttggttttgtcttctctccccncgagtattgcggt

SEQ ID NO: 316137 - DNA, 1771 bp, Homo sapiens
  misc_feature (1)..(1): n is a, c, g, or t
  misc_feature (20)..(20): n is a, c, g, or t
  misc_feature (81)..(81): n is a, c, g, or t
  misc_feature (100)..(100): n is a, c, g, or t
ntacttgctgaaggaagatnaacctacgagttttccgaagggggctggaatgttcctcttgggaggcttctttggtggtgnaccgtgaacgagatgaaanaggatgatgagctactcccagacaaggatgctgacgaacgtcttcttcgtcttactggagatctactccttctatgccttggtggaggaggcattcttcttggcggagttcttcttcgaggagatgactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316138 - DNA, 1695 bp, Homo sapiens
agaatagatagaggattatggggctttagccaccctctgggaaacataggtaatgtaaattggatatatgttagttgaatcaaccagcaatctaagtggtatatttgaaattcataacctggttgtacagtgtagttggtggttttctcatgtgaagagagatggctgttctcaatgctgaatgttttttcctttttgtctagggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316139 - DNA, 2118 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggtaacatctttgcttcagtgatgttcactgatgttctgtaattgtgatgaaatttgataacttgggattatttgagaatttggttaactccttcaagtatttggatgtggttggatttttgtttgctttttagggtttctgttttgttttgtttttgctttattggtggttattaataattaatttagaattggtaaattttaaaccaccatgtcatatatgtgtgcatgattagaaaaataaaccaaactattatagcagta

SEQ ID NO: 316140 - DNA, 1653 bp, Homo sapiens
tagtggctaccatattagtacaatctatagtatatcctagaatctagaaaaaaaatcaaagtttctgagtgttttattcctaggagagcccttcagtttctcacttagaaatcactatgacttatttatactagaacttttaagttcattgattacttctcctagctcatatcttataagcaacaaactagaaggtagaattctatttagaggcagagaggtttaccagcagtataaaaggtcagctaacaagagaaacagtcagattgtaaaagacagaaatactgaaaaagaagaaaaagaaggacaagaaacacaaaaaggataagaagcacaagaagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316141 - DNA, 1280 bp, Homo sapiens
cggacgcgtgggtcgacccacgcgtccgggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 316142 - DNA, 1799 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcgggtaagtttgttgtttttttttgtgattttggtttgtttgtttttgtttttcttaaagctgattttgattttttgcacatttggtcatccccttctgcttgaagattaagtatagggtaagagctaagactctgaaggcagacagacttgggtggaatcccccattccagaatttaa

SEQ ID NO: 316143 - DNA, 1527 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccaggtgcgtaggcgacggcgtatgcgccttgtctatgcagacaccatcaaggacctcctggccaactgcgccattcagggcgatctggagagcagagactgtagccgcatggtgccggctgagaagacccgtgcggagagtgtggagctggtcctgcctcccca

SEQ ID NO: 316144 - DNA, 1384 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaacgacgttcgtcagcactcctgctctgggcagctagcctcactcatcctccttcactcttcgaccttttgaccgcgctacggcgtacccgagcctcgaaattcgctaactcat

SEQ ID NO: 316145 - DNA, 979 bp, Homo sapiens
cggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaaggcctgaaccaaaatggaagttattccttgcgtctgaagtatagcaccatcaccttattaggtcacagcagagtgagtgtcccaatgtcgctctgacccaactcccttgatgatgcagtgtgtgtttggaggtgagttgtgtaaagtggccaaacatcaacaacaacaacaaaaaacacaaacaggaaagagcaattgggtaaagctgtacactgctcttttaaaatactattatgagatggacatttatgtgaagcatgaggggcaattctgatttgattggatattgtttttaaaggaactaaggtctttgtagctgcatgtcagctagtcatcagttacattttagagacaggatttttgtttatacttaaacttcagacaaattggcagcatataattgttcctttatacatgagataatatgatgatataactgatgtttaagaacattcttattgtaagacagtttctgttttgccacagcaacccaaaggacagttaagatatgtaccatat

SEQ ID NO: 316146 - DNA, 205 bp, Homo sapiens
gcggaggttgcagtgagccaagatcatgccattgcactccagcctgggcgacagagtgagacgccatcacacacacacaaaaaaaagaaaaaaaattaactataattcttcttggtttagtggtagacggaggagaagtccatccccaccacccaccagaaggcgacggtctccttctcccgcccctcctcctcgacggcgcagg

SEQ ID NO: 316147 - DNA, 484 bp, Homo sapiens
atgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaattttgccactcttacttagtagtgcttatgtaaaccttttggtgtgttgggagttgggcaggggaaagaaaaggtgatgaaattaaggttttaccatctttatttcaataattactgtggtgagtgctataaagggaatcagcatgtgattggaacatttagaatactggtgggagaagtccaccaggcaaagagaacaggattgcagtcagacaa

SEQ ID NO: 316148 - DNA, 5277 bp, Homo sapiens
  misc_feature (1816)..(1816): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgagtcactgaaaactaagctgcgctttcctaaagtcctgcgaactgaagccagacaacttaaacctcagaagaaaataacagcaacctatttatatacataagccactttcatacctgcctactgttgtatagacttcagagtaatgtggcctgtatcgattttccaggagtattcttttgtgtgttgttttttctcaattcctcctattttctctttacaggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaaggtcagttgataggatgaatgaaaaacaaaaattggaagtaatggtactagtaataagtggggattttcatgtaggtaaaggaactgataagtcatagggaatccgtgagttcttaatcttactgagtttagttgtgttctttgattattttggatagctttgtttaacggtgaatgaaatgattaaaatggaaaaattaagtgcagaaaatatgtttaacattatataggatgtcttgttttaggcatttattgctagataacatatgtccattcttgtattgctataaagaaatattggatactggctaatttataaataaaagagatttattggctcatgattctgcaggctgtacaggaaatatgattctggaatccgcttggcttctggaaaggcctcaggaaacttagaatgatgacacaaggcagaggggaagcaggcacatcttacatggcaggagcagggagcaagaaagagtgaagcgggaggtgctacacacttttaataatccagatctgagtcaggcatagcagcttatgcctataatcccagcacttttgggaggccaaggcaggcagatcacctgagggtcaggagttcaaggccagcctggccaacatggtgaaacctcatgtctactaaaagtacaaaaattagctgggtgtggttgcacctgcttataatcccagctgctcaggaggctgaggcaggagaattgcttgaacccgggaggcagatgtttcagtgaaccaagattgcaccactgcactccagcctgggtgaacagagtaagactctgccttaaaagtaaaataaaattaaattaaaattaaaaaccagatcttgcaagaactcactgtcagaagaacagcaccaagggtatggtgctgaaccattcatgaaggagccatcctcaagatccagtcatctcataccaggtccacctccatctaatattgggaattacaattcatcatgagggttggtggagacatggatccaagccatgtcacatattatcctgactgtagtggtttaagataacaatttttatctcacaatttattttgaatacaggcatgatttagctgtgtcctttggttcagtatctcttcaaagctgtaatcaggtttttcatgtgtttgtcatcaactgaaagattgactgagtatggttctgagatctctcaggtgattattggcagaattaagttccttttcgattcttggtcttatttcttcacccatctactatagtgcattcttgccatgcagccctttttatggagcaagtcacaatacagcagcttgcttcattagggcaagcaagcaagacaagctgcagcaaatgcaagtaacatggaagtctttataatctaatcatggaattgacatagttaaaaacaaatcattaggtaggctccaaattgatcagaacatggttattggacaaaaccatgactgtcaggaggctgcatcatggggagccattttacaagcagcaccatgggtgttatgggggattttattacatttgttctgctcttaagagttgaaagtctttaaaaatgtgtaagtctgtcgtttgttcttgacttctgtcatgttttcaagaatgcattatgcaatgatgtagaatactgtttgtaaagtagttgtctagactctagtgaaaataattacagataatctcagttcatcaacgaatcggtatattaatgtcatatttaacagttataggaataaactaagcataataataaatgatgatttgaatgttattataattatta

SEQ ID NO: 316149 - DNA, 344 bp, Homo sapiens
tcaaactttattcttacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtgagttgctagctgaagaatt

SEQ ID NO: 316150 - DNA, 10047 bp, Homo sapiens
tgaataattgaactttgtttatttctccatatttttgcagtggtaattccattataaaacctaatgaaacaatgtttttatagatggtgtggaaagacttttctgggctcagaggtgaaactgacccttgtgtatcagcagcatttctgactgactgagagagtgtagtgattaacagagttgtgatgttagttaagaaacttagatttgccattgtagcttttctaccaattagcagattgtttaactcactgaaattgtaaagtggtagacgtggacttagtcattactgggcagcttatgaattgtattcatttactcatgatgtaaaaatggttagtctccacttttaaggctctagttctagtggctaaataggtacttatttatacagtatgataactgctgtattaaaatacatgtctcaaatgtggaatagtagaagaggtgaagaaaatcatagtttgaggtagaatactgtttgctggtcttaaaaactgtggtattttggtgattccataaattaggtcagatacttccactggagggaaacagtttaaaggatatatgtgatactattaatagaatgaggaagacacaccagatatttaggagggaattagcgagcttgaaactaagagctggtttgaatgagactgggtcataagtgatttcaagtaccagattaaggcactgagattttatttttaagcactgaagtcagattttttccttttaaaagaaaggattcatgatgaaatctgctttttgttttgcagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagaagaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattttacctatgtcgagagcattttgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaccttggagaaggcaaacttagtccaccccttgactcccttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactattttttagcccaaatgaagaaataactaaaatttatcagatgaccaccaatggaagcaataagctggaggtggaagatgaacaagtttgttgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccagggctgcccacataggtttgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacctttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaatacctcctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaagacttttgtcctg

SEQ ID NO: 316151 - DNA, 12529 bp, Homo sapiens
  misc_feature (1595)..(1595): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagaagaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattttacctatgtcgagagcattttgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaccttggagaaggcaaacttagtccaccccttgactcccttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactattttttagcccaaatgaagaaataactaaaatttatcagatgaccaccaatggaagcaataagctggaggtggaagatgaacaagtttgttgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccagggctgcccacataggtttgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacctttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaatacctcctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaagacttttgtcctg

SEQ ID NO: 316152 - DNA, 12750 bp, Homo sapiens
  misc_feature (1816)..(1816): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtgagtcactgaaaactaagctgcgctttcctaaagtcctgcgaactgaagccagacaacttaaacctcagaagaaaataacagcaacctatttatatacataagccactttcatacctgcctactgttgtatagacttcagagtaatgtggcctgtatcgattttccaggagtattcttttgtgtgttgttttttctcaattcctcctattttctctttacaggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagaagaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattttacctatgtcgagagcattttgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaccttggagaaggcaaacttagtccaccccttgactcccttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactattttttagcccaaatgaagaaataactaaaatttatcagatgaccaccaatggaagcaataagctggaggtggaagatgaacaagtttgttgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccagggctgcccacataggtttgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacctttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaatacctcctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaagacttttgtcctg

SEQ ID NO: 316153 - DNA, 12943 bp, Homo sapiens
  misc_feature (1595)..(1595): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagaagaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattttacctatgtcgagagcattttgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaccttggagaaggcaaacttagtccaccccttgactcccttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactattttttagcccaaatgaagaaataactaaaatttatcagatgaccaccaatggaagcaataagctggaggtggaagatgaacaagtttgttgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgagagtaatgttgatccccgagatgatgtatttggatatcctcatcaatttgaagacaagccagcattaagtaagacagaagataggaaagagtataatattggtgtcctaagacaccttcaggtcatctttggtcatttagctgcttcccaactacaatactatgtacccagaggattttggaaacagttcaggctttggggtgaacctgttaatctccgtgaacaacatgatgccttagagttttttaattctttggtggatagtttagatgaagctttaaaagctttaggacacccggctatactaagtaaagtcctaggaggctcctttgctgatcagaagatctgccagggctgcccacataggtttgaatgtgaagaatcttttacaactttgaatgtggatattagaaatcatcaaaatcttcttgactctttggaacagtatatcaaaggagatttattggaaggtgcaaatgcatatcattgtgaaaaatgtgataaaaaggttgacacagtaaagcgcctgctaattaaaaaattgcctcgggttcttgctatccaactcaaacgatttgactatgactgggaaagagaatgtgcaattaaattcaatgattattttgaatttcctcgagagctggatatgggaccttacacagtagcaggtgttgcaaacctggaaagggataatgtaaactcagaaaatgagttgattgaacagaaagagcagtctgacaatgaaactgcaggaggcacaaagtacagacttgtaggagtgcttgtacacagtggtcaagcaagcggtgggcattattattcttacatcattcaaaggaatggtaaagatgatcagacagatcactggtataaatttgatgatggagatgtaacagaatgcaaaatggatgatgatgaagaaatgaaaaatcagtgttttggtggagagtacatgggagaagtatttgatcacatgatgaagcgcatgtcatataggcgacagaagaggtggtggaatgcttacatacctttttatgaacaaatggatatgatagatgaagatgatgagatgataagatacatatcagagctaactattgcaagaccccatcagatcattatgtcaccagccattgagagaagtgtacggaaacaaaatgtgaaatttatgcataaccgattgcaatatagtttagagtattttcagtttgtgaaaaaactgcttacatgtaatggtgtttatttaaaccctgctccagggcaggattatttgttgcctgaagcagaagaaattactatgattagtattcagcttgctgctagattcctctttaccactggatttcacaccaagaaaatagttcgtggtcctgccagtgactggtatgatgcactgtgcgttcttctccgtcacagcaaaaatgtacgtttttggtttactcataatgtcctttttaatgtatcaaatcgcttctctgaatacctcctggagtgccctagtgcagaagtgaggggtgcatttgcaaaacttatagtgtttattgcacacttttccttgcaagatgggtcttgtccttctccttttgcatctccaggaccttctagtcaggcatgtgataacttgagcttgagtgaccacttactaagagccacactaaatctcttgagaagggaagtttcagagcatggacatcatttacagcaatattttaatttgtttgtaatgtatgccaatttaggtgtggcagaaaaaacacagcttctgaaattgaatgtacctgctacctttatgcttgtgtctttagacgaaggaccaggtcctccaatcaaatatcagtatgctgaattaggcaagttatattcagtagtgtctcagctgattcgttgttgcaatgtgtcatcaacaatgcagtcttcaatcaatggtaaagtagcatgttccatttcttttacagcagtttaaaaataatgctagctttatgtagcacttgataaaaagtagctctgaagatttataaaaatgaaattagtctgaaggcctatgttctagaatattatatttcttaagttttagctttttcatatgtttaatagggagtttattttttaaatgtaggatactgtgatatcttatgaaatgcttagtgtaaaaatgataaactttgtctttagtgtcagcatttatattttgcattttatcatcttggtatatacctgaccatttaggtgaatttttaatttaatttaaaatcagattgtattttttaagttaagaagtttattattataattttgtgaggaattctattggtttttcattgataacaaatctgttctaggtaatccccctctccccaatcctttcggtgaccttaatttatcacagcctataatgccaattcagcagaatgtgttagacattttatttgtgagaacaagttatgtgaagaaaattattgaagactgcagtaactcagaggataccatcaaattacttcgcttttgctcttgggagaatcctcagttctcatctactgtcctcagcgaacttctctggcaggttgcatattcatatacctatgaacttcggccatatttagatctacttttccaaattttactgattgaggactcctggcagactcacagaattcataatgcacttaaaggaattccagatgacagagatgggctgttcgatacaatacagcgctcgaagaatcactatcaaaaacgagcatatcagtgcataaaatgtatggtagctctatttagcagttgtcctgttgcttaccagatcttacagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagaggagccagatgaccaggatgccccagatgagcatgagccctctccatcagaagatgccccattatatcctcattcacctgcctctcagtatcaacagaataatcatgtacatggacagccatatacaggaccagcagcacatcacttgaacaaccctcagaaaacaggccaacgaacacaagaaaattatgaaggcaatgaagaagtatcctcacctcagatgaaggatcagtgaaaagcaataattaactgcttcctttatgactatgcactaaggtcttatagtccaaactttctctgtgtctggctagtattgaaaactagataaactgctccaaaccaacatggagtaaagagcatattcactggtttatttgcagtaatttgcaatttgtcagtgtataagacacatgcagggtgaagtgtacagagttttgtaacaaatgactggtcctaatctgtaaatgagaaaggtatatatactatgttaatgtctgactgttaattcttaagcaagaaactttttttgatgaaaacaagtcagatctacacagtcacacaattattttttgttgtgttcactacattgtgcaattgatattgcctgctttgagcagtttggtcaacttaccaacttccccccaaaaaagggaacataaaagagcccatctttgtcagtttacaccaatagtttcttgttaatccttctttcctggatatataaggctggtggtaacttttgaattatatggttgatgtggaaaattggcagtgtaacatttctagatacttttcattacctttttattctggtatataggctaaccactttaaagctattcttatgctgtaacagttagcatggcttcacactgtttgtgtagccaagaggacagaattacatgaatgacagtgcccagagtgacagctgtatattgctcagagcttttatttcttatacctagaataaatataaaatgggggaaaaatgtgacagacaagcagtttttcattgcacacatattcttcacatttaatgtttgatagttcaatttcttgagctgaagaatatcaaagtatcgataatacgaattttaaaatattaaaaccaatacacaaaattttcctatgtcagaatgtggtggagcataatagattgtatttggtgtgcttgcgattttttttttccatagaatttattaagtgaagtttctaaaactttgcttctcctgatcccggtgaagtgtacatcataagaatccatagtactttgaagtaccattgcaccaagatgtctgactgaattcatagtcacacttttatttgaaagaaagaattgttgtagttttttttcattattctaaaactcttgttgttagatacaagatttaattaagatctaagctcctgcttatttaatgtaattctaaggtaccattttagaaaaaacatttgttttaagattccaagaaacctgtgagttaatactatatttaaaagagaattggtaaattttgaatgtgtgtaatattttggaacctgtttaaaaaccaaatatacctgcaaatagatacagcctatcctatactatttaaatgtttggctgttttgttttatagaaattattttgctgaattcacaaataaaatttaagaagacttttgtcctg

SEQ ID NO: 316154 - DNA, 8852 bp, Homo sapiens
  misc_feature (1595)..(1595): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagaagaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagatcatgaagactatgatccacaaacagtgaggcttggaagtcgatacagtcatgttcaagaagttcaagaacgactaaacttccttagatttttactgaaggatggccaactgtggctctgtgctcctcaggcaaaacaaatatggaagtgcttagcagaaaatgcagtttatctttgtgatcgtgaagcctgttttaagtggtattccaagttaatgggggatgaaccagacttggatcctgatattaataaggacttctttgaaagtaatgtacttcagcttgatccttcccttttaactgaaaatggaatgaaatgctttgaaagatttttcaaagctgtcaattgtcgagaaaggaaactaatagcaaaaagaagatcctatatgatggatgatttggaattaattggactagactacctttggagggttgtgattcagagtagtgacgagattgctaacagagctatagatcttcttaaagagatatacacaaaccttggcccaagattaaaagccaatcaggtggttatccatgaagacttcattcagtcttgctttgatcgtttaaaagcatcatatgatacactgtgtgtttttgatggtgacaaaaacagcattaattgtgcaagacaagaagccattcgaatggttagagtattaactgttataaaagagtacattaatgaatgtgacagtgattatcacaaggaaagaatgattttacctatgtcgagagcattttgtggcaaacacctctctcttatagttcggtttccaaaccagggcagacaggttgatgagttggatatatggtctcatacgaatgacacaattggttcagtacggcgatgtattgttaatcgtattaaagccaatgtagcccacaaaaaaattgaactttttgtgggtggtgagctgatagattctgaagatgacagaaagctaattggacaattaaacttaaaagataaatctctaattacagccaaacttacacaaataaatttcaatatgccatcaagtcctgatagctcttccgattcctcaactgcatctcctggaaaccaccgtaatcattacaatgatggtcccaatctagaggtggaaagttgtttgcctggggtgataatgtcagtgcatcccagatacatctctttcctttggcaagttgcagacttaggtagcaacctgaatatgccacctcttagagatggagcaagagtacttatgaaacttatgccaccagatagaacagctgtagaaaaattacgagctgtttgtttggaccatgcaaaccttggagaaggcaaacttagtccaccccttgactcccttttctttggtccttctgcctcccaagttctatacctaacagaggtagtttatgccttgttaatgcctgctggtgtgcctctaactgatgggtcctctgactttcaagttcacttcttgaaaagtggtggcttacctcttgtactgagtatgctaataagaaataacttcttgccaaatacagatatggaaactcgaaggggtgcttatttaaatgctcttaaaatagccaaactgttgttaactgcgattggctatggccatgttcgagctgtagcagaagcttgtcagccagttgtagatggtacagaccccataacacagattaaccaagttactcatgatcaagcagtggtgctacaaagtgcccttcagagcattcctaatccctcatccgagtgcgtacttagaaatgagtccatacttcttgctcaggaaatatctaatgaggcttcaagatatatgcctgatatttgtgtaattagggctatacagaaaattatctgggcatcagcatgtggggcattaggactattttttagcccaaatgaagaaataactaaaatttatcagatgaccaccaatggaagcaataagctggaggtggaagatgaacaagtttgttgtgaagcactggaagtgatgaccttatgttttgctttacttccaacagcgttggatgcacttagtaaagaaaaagcctggcagaccttcatcattgacttattattgcactgtccaagcaaaactgttcgtcagttggcacaggagcagttctttttaatgtgcaccagatgttgcatgggacacaggcctctgcttttcttcattactttactctttaccatactggggagcacagcaagagagaagggtaaatattcaggtgattatttcacacttttacggcaccttctcaattatgcttacaatggcaatattaacatacccaatgctgaagttcttcttgtcagtgaaattgattggctcaaaaggattagggataatgttaaaaacacaggtgaaacaggtgtcgaagagccaatactggaaggccaccttggggtaacaaaagagttattggcctttcaaacttctgagaaaaagtatcactttggttgtgaaaaaggaggtgctaatctcattaaagaattaattgatgatttcatctttcccgcatccaaagtttacctgcagtatttaagaagtggagaactaccagctgagcaggctattccagtctgtagttcacccgttaccatcaatgccggttttgagctacttgtagcattagctattggctgtgtgaggaatctcaaacagatagtagactgtttgactgaaatgtattacatgggcacagcaattactacttgtgaagcacttactgagtgggaatatctgccccctgttggaccccgcccaccaaaaggatttgtgggactcaaaaatgctggtgctacgtgttacatgaactctgtgatccagcagctatacatgattccttctatcaggaacagtattcttgcaattgaaggcacaggtagtgatttacacgatgatatgttcggggatgagaagcaggacagtgaggtaaattttaatactgttttctttgaagagtctgatagcagatgctgttgttctccctcagattactatactttcatgggatgttatggggactacattttgatgatacagacagaatctctgagatactatgtctggcatacttgtagtactcactatgtaatagacttaaaactccagttgataattaaacactgtttttttgtttgtctccaaagcacagttaatataatcgcattttgtgtgacatggtaaatgtaatttggtatttgaaaaatgatgaatctatttatttttaataattacattttcattgccttgttttttaaaatctgttatttcatttctttcactttttatattgtctgtgtttcataagctgtacttatttttaggattctctatttttctcaaattagagctctttctgctaaggaaacaaatttgtttctcagctaatgcttcacggacctgttaacaatattagttaacagttgcagtcaggctgcctatgaaatgtatccagttgaaaataaagcagtaaaaaagttaggttttagtggcagatcacatatttaagatgcaggtcttaaat

SEQ ID NO: 316155 - DNA, 3727 bp, Homo sapiens
  misc_feature (1595)..(1595): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagagatggggttttaccatgttgcccagccaagtcttgaactcctggattcaagctacccacctgcaatcgcctcccaaagtgctggcattacaggcttgagtcactgcgtccggcctccatctgttaaatctaacattcctgttacatctgagtatgaatttgatgcttgctctgtctcttcaaacagtttttttgtcacctagt

SEQ ID NO: 316156 - DNA, 5413 bp, Homo sapiens
  misc_feature (1595)..(1595): n is a, c, g, or t
tttttttgtcagccgggttcaatgcgccatattgaagaggacgggtctaatagatcgctggagacacaatttaactgaaccccgcccgttgtggactgactttgatgctctgagtccctccctccttcacgccgctagcaggccctgatgtagattgcctttgtcttacttgggacgtttacctgagcgcttggtgctggtgtcgggaccgggagataggagtgtctcaggagagacctggccgaaaaccgcgagaaagaaaagtgaagcctagtgaaactgcctttgcagtgactcaagaaaaactcatcacctggagtccgtgtaagctcggcgacagccctagcagcgaggccaaaacagtttgggaagaaagaaaacctaaagtatttgccgttggtgattcaagggaatcaaacttgacgtatggagccaagaaagcccttggaaaaactggcctcatattttgtgtacacagtccctgtacagggtttctgacctgtggatgtgagacttcacaacctgctaaaaatgagctttcaggacctacccatataggaataaaccatcctagccatgagagatcagatgaaacctgagaccagagagactcatttgtttcaaaatagtttctccaaaagattttataaaagaaaaggctggggggagtgggatatgaaaggaaaatgaatcttggggcccccaaatcactaagctcaagggataagtcaagttagaaactgttcagggccaacttaccttgcattctattcaaattcacccctctgctcacttagatgcatatctgattgtaatcagaaactcaaaagaatgcagcagtttgtctctcacctatctatgacctggaagcccccttccccgtttgagtcttcctgcctttgcttcactttatccctgcctttctagactgaaccaacatacttcttagatatattgattgatgtctcatgtctccctaaaatgtataaaactaagctgggccccaaccaccttgggcacatgtcgttaggacttcctgagactgtgtcacaagtttgtgtccacaactttgacaaaataaactttttaaattaactgagacctgtcctaaatttttagggttccatcagatatgcatttctctcacctgagcatcagagggatgatttcgagttctctgtgttttttgtccacaggaatttccttgtgggcaaattctgagggagggatgtagcttttttatgtttggagctattttatttagaaataaaatgggaggcaggtttgcctgagtcagttgcctgcttgacttcctttggcttagtcattttggagtcctgagatttattttcttttcacatacctgttttatttatgatggtttatggtcattgaaccttgtaacattgattacatttcttttcactggtcttttttcttaagtagataaacttatttttaacttgggcacaagagagcataaaaattatatgaggtacatagcctgcttaaatagaatatttaaaatacgttttgtccacagagctggaattctttgtaaatgaaaaccaaattttacttaatttttagagatnggatcttggctttgtcgcctaggctagagtgctgtgggggcaatcatagcccactgcaacctcgaattcctggcttaagtgatcctcccatctcagcctcctgggtgcttggacaacagacatgacaccttacctggctagttaaaaaaaattttttttgtagagatgggctttgcctgtgtggcccaggctgctcttgaactcctaggttcaagtgatcctccagcttgggccttccgaagtgctgggattacattgcttccagctttagttttttaaatgtttaacttgtttaacttatttaacttgctgtttattatttaatggagagcttttagtgtttgtcttttgaggtgggatcttgccatgcccagactagccttgaagtcctacagtcaagtgatctttgcatctcagtctcccaagaagtagtggtagagaatttttatgttacattcctttctctgtgtatatgtttgtgggaggacatatgtccctttgtatgtttgggcatatatattttttgtgtgaaagttatgcatgttattgttgatcaatacaagaggtttagaggccagagaagagaaataaaatgggaaaaactacaaacattctacctcccatgataccatgctataatggcaatcataatatttatgtattttttacttttttgtgttcatttttaaaaattagataaaaatagtttaagctagaggcttctctctttcatctttttttttctaatttaagttttccctaagtaggaattttggtaatacttcattatattgatgtatcaagatttctttagtttctcctttgttgtctttaggttgtctacaatattttttgtcattgtgaatatgctgtcatgaacattttgatgctgattattaccagattagtgtgttgtgtcaaagttttcatcagttggattatttttcagtttagtaagtgatgcaagccaaaactaaaactctaaggcaccttctccccacccaaccagtcatctgagtagacttcctcctcagccagggcagtcatagcccactgcaaccagccagcccctttccattccagtatccctttccctttaataaaatttaaggccaaacatggtggttcaatgcctgtaatgccagcactttgggaggctgaggtgggcggatcatgaggtcaggagataaagaccattctgggaaacatggtgaaacactgtctctactaaaagtataaaaattagctggatgtggtggcatgtggctgtggtctcagctactcgggaggctgctgaggcaggagaatcgcttgaacctggggaggcagaggttgcagtgagcagagatcatgccactacactttagtctggtgacagaatgagactccatctcaaaaaaaaaaaaatgatttgtgagatgaatttgttttgaaaatattagcttgttttcagttgtgatacatttgaagttggtacagagtccattttcttttatgtgttaatgtattgacaatatagttgtgttgacaacttcttttcttatttccagttcagtctttacagaagctgacgagagatttccttgtattttatggtggtatgattggccttagagcacttcagttttgagatctctgctgtatttgtatacaagtattttggaagagagcttggagataattctggtggctgtgtggagtatgtgttggaggtattaaattttcacagtatatataaggcagcaattgataggcctttcacagattcttctgataactacataaagagacaaaaaaaagaaaaaagagcaaagatctgtgctgtgtcaagtatgacagccatcactcatggctctccagtaggagggaacgacagccagggccaggttcttgatggccagtctcagcatctcttccaacagaaccagacttcatcacctgattcttccaatgagaattccgtagcaactcctcctccagaggaacaagggcaaggtgatgccccaccacagcatgaagatgaagagcctgcatttccacatactgagctggcaaacctggatgacatgatcaacaggcctcgatgggtggttcctgttttgccaaaaggggaattagaagtgcttttagaagctgctattgatcttagtgtaaaaggccttgatgttaaaagtgaagcatgccaacgtttttttcgagatggactaacaatatctttcactaaaattcttatggatgaggctgtgagtggctggaagtttgaaattcatagatgtattattaacaatactcatcgcctagtggagctttgtgtggccaagttgtcccaagattggtttccacttctagaacttctcgccatggccttaaatcctcactgcaagtttcatatctacaatggtacacgtccgtgtgaattaatttcctcaaatgctcagttgcctgaagaagaattatttgctcgttcttcagatcctcgatcaccaaaaggttggctagtggatctcatcaataaatttggcacattaaatgggttccagattttgcatgatcgtttttttaatggatcagcattaaatattcaaataattgcagctcttattaaaccatttggacaatgctatgagtttctcagtcaacatacactgaaaaagtacttcattccagttatagaaatagttccacatttattggaaaacttaactgatgaagaactgaaaaaggaggcaaagaatgaagccaaaaatgatgccctttcaatgattattaaatctttgaagaacttagcttcaagaatttcaggacaagatgagactataaaaaatttggaaatttttaggttaaagatgatactcagattgttgcaaatttcctcttttaatggaaagatgaatgcactgaatgaaataaataaggttatatctagtgtatcatattatactcatcggcatagtaatcctgaggaggaagaatggctgacagctgagcgaatggcagaatggatacagcaaaataatatcttatccatagtcttgcaagacagtcttcatcaaccacaatatgtagaaaagctagagaaaattcttcgttttgtgattaaagaaaaggctcttacattacaggaccttgataatatctgggcagcacaggcaggaaaacatgaagccattgtgaagaatgtacatgatctgctagcaaagttggcttgggatttttctcctggacaacttgatcatctttttgattgctttaaggcaagttggacaaatgcaagtaaaaagcaacgtgaaaagctccttgagttgatacgccgtcttgcagaagatgataaagatggtgtgatggcacacaaagtgttgaaccttctttggaacctggctcagagtgatgatgtgcctgtagacatcatggaccttgctcttagtgcccacataaaaatactagattatagttgttcccaggatcgagatgcacagaagatccagtggatagatcactttatagaagaacttcgcacaaatgacaagtgggtaattcctgctctgaaacaaataagagaaatttgtagtttgtttggtgaagcatctcaaaatttgagtcaaactcagcgaagtccccacatattttatcgccatgatttaatcaaccagcttcaacaaaatcatgctttagttactttggtagcagaaaaccttgcaacctacatgaatagcatcagattgtatgctggagagttttgttcttgttgcacaggcaggctggagtgcaatggcaccatctcggctcactgcaaagtctgccctccaggataactacat

SEQ ID NO: 316157 - DNA, 466 bp, Homo sapiens
gggctgttcgatacaatacagcgctcgaagaatcactatcaaaaacgagcatatcagtgcataaaatgtatggtagctctatttagcagttgtcctgttgcttaccagatcttacaggtgagggtttttctcttataaatttgtagaaacctctgtcacaagtaaggaaatgatcgtgaaatttttgtattagcattttaagctgatactgaaaatcattctaaattctaaatagttttatttttttctaaagggtaacggagatcttaaaagaaaatggacctgggcagtggaatggctaggagatgaacttgaaagaagaccatatactggcaatcctcagtatagttacaacaattggtctcctccagtacaaagcaatgaaacagcaaatggttatttcttagaaagatcacatagtgctaggatgacacttgcaaaagcttgtgaactctgtccagaagag

SEQ ID NO: 316158 - DNA, 673 bp, Homo sapiens
atgcaacacatgtgctttgatactaatagatactttttatttttaaataagaatactgaaatggatatttggttggaggcatggattatattttttacagggtttgatattttgttaaggggaggatattgaccacattttgttaagaatgtatagcattaaaaatttttaaagtagtagctagaatttagcttctgtaaactctcttaattatagcaattttcatgtgccttattatactgttaagttcttcttatttcagtcaaactcagcgaagtccccacatattttatcgccatgatttaatcaaccagcttcaacaaaatcatgctttagttactttggtagcagaaaaccttgcaacctacatgaatagcatcagattgtatgctggaggtatgtatgataagctaaaattaactatggggaatcaactttgttttgctctaaatgttaataacctaagaaataacaacatttatttttgaatgagaaaaaatagaagtggatttatacttcatattgcattcacttaaggaatatgatctacttggtatcccaaatcttaggcaacctaaactctaggccacctttcccagtgtctttattaaatgcatgtctacttactcatccttcttcttggtatcttttctttcatacctgggagctctgc

SEQ ID NO: 316159 - DNA, 317 bp, Homo sapiens
gcgtcgacttattttgttgttgttcataagatacattttgtttttatttcagaactgttcgtcagttggcacaggagcagttctttttaatgtgcaccagatgttgcatgggacacaggcctctgcttttcttcattactttactctttaccatactgggggtgagaagttttcaaatgaacttatcaatataatgcattcttaacatgagagacattcagaaagttactacgatagcttttattgtatttagaacaggcataattaataaatgcagtattataattttttactatttgtagattggctttttgttt

SEQ ID NO: 316160 - DNA, 5181 bp, Homo sapiens
gcaaagagctaaaagtggtatcatgattccacagcagtgattgtaagacagtgagccacagggaaatgggaaaacgtgaaaagaaacaagtatcaggaccaaattagagaagatatgagtagggccatcactagaggtgaaaatggagaaacctaagaaaaccagtgttggcatgaattatgcaagtggaaaatacatctgtagagggacgagatagaaggacctagatctaactccaagtgcttgattggagaagagagggagaaagagaatttatagaattaactgtatagaagcctaaaaaataagattatcagcctagtcatgtaaagtctagaagttcctttatttgctcatcacctttcctttttctataagactattaagcagaaggtcagtaacagaaaatttaccctttcctctcctctcttggtttaaattttataaggaatctgaagaggctatggatcagttggcattacagtgggaagagcttattgaagcaaggttgacaataggtcttgtcattctgctccctgaaaatgcccttcgacaactgtgtcaggcagaaagcacacgcaaagtgctcaggatggaacttgtaccccatggcactgatacaacggccagtgatgggctgcccacacccatggcagagcgttccccggcggtgatggtaatggagctcacagaatggacgtccatccagttcaaagaaggagccagtagaaaaactggtgaagcagtccccacaaacaaagcactctgggtggccagacagtgtccatggctgaaaggtagttttccaacactgggcgattgcagccaccacacttgggtgagaacatggctaagaaatcctttcggcaatatagcttcttgtccttctcatgaaagccttctgcaccaaacacctctccgcagtgagagcagaagaagtgctctgggtgccaggtctggttcattgctgtcagcactttatccaggatgggagcagcgcagtaagcacagcgtggagaaaaaagttggtggtagtcgttggggcagtaggccaagccactccgctcaaagaagggactggagccaatctcttctttgcaatgagtacagacaaaatgctcaggatgccatgattgccctagagcatggatcaccttcccagcaatcggtttctggcaggatgcacaatggcccttgggcactgtggcaatgccaaggtcctgcaattcctgctccagacccccaagcattgagtccagggaggccttgtgatcctgcttgtctggctaagtgcttcttgccagcatctgctctcactgcaaccttggcctgcatctcagtcgaggtgagccatgagctcatccaactcgagcagctgctgacgttttatgaaggtggtggtgattcctttggctcttgggcttcaactgtagacattgagctcctggatattggtagtatacacgagctgcgccggcaagggacttgtgttatcctgaatagaaaggatctccgaagtctcatcaaggttagtctcctttctggaattgctgatccaggggaagaggagctgggttggaatattcatcactgtcctgaagggtggagcgttccagttcctccaataaggcatctaactcttccattgtcctacatccaagatgctcttgtctcacaggccgtgaggaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctgggctgaggcaagagggttgcttgaggccaagagttcgagaccagtcttggaaacacagtgaaaccatgtctctacgaaaactaaaataaaataaaatgtaaataaataaaattttaaaaataaatcagttggatgg

SEQ ID NO: 316161 - DNA, 1880 bp, Homo sapiens
  misc_feature (478)..(478): n is a, c, g, or t
ctttccttcacatgttaaaaaattaaagacatgaaaaataaaataccaaaaaagtactaacatacaatcatttgccttgcaaatttcaataatttggatttcctggtatgacatctatttctctctacaaaatttgagcttcgaggtaggctcagtgtgctaaacagggttaggatgctaactatgttgctatgtaaaccagtcctggaatcgtaattgaagccatgaatcatcaagatggtcttaaagcatttgctggtcatttttgatgacccaaggatggcaatattatcagctaggaatgtctgctagctccctttctttcacagaatttttaaaatgtgtcattttggaaattaacagaaacaaacagtgcctactttgtgtctgtatttgcctggatgaggctctttcaacaacactcttttcttgtcctctgatggaagaggatcctttctacattattaattcattcatncactcatgtattcatttactcaacaaacatatactaatattacgcctcaactagtgccagacactacattatgtggtaggacatggtagtggataagacagatgcatcttttactaaacagagtctcttactctgagcagttaagaagtttagccttccccaagttattcagcctctttctttcttcctgtgtatttccaaggcattaccacaaggctctgatttgctgctgacctctgtaactggaggatcccagagctgtgggtctgggcacatgcagtgggcatctctgaggtgacccctaagaagcaagtctactcaatgctgtgcagacactggctacttcaggggccacaaataccaatggaggatcaaaatgcacaaagtaattgcctcctgatgctttattttattttagaagtcagtccagctctcaacaacctacagcaaaccctgaatattgtgacagttcagaaagaagtgatagacaccaatctcacaactctccgagatggtcttcatgggatacagagaggtcagcatcttcctaatccattgtactcggttggcttcttttgttgaacgttttagatacttatacctccctatctgtgtgtgcattaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcgggtatcaggcgatctctggccaggacatcttagccattctctccattgttatgtgttttggtccatttccattcttccctggtaaagtctgatctcagaaactaaaacattagaaaacagctccacctgatacaggatatattcaaagcgtatagatatcctgctagttggaaggaccagacaggatttttaatttttagaaaatacattgaaaatgctattggtttgcttttttacaaagtggagatatatgtttctaaatcatgaggcattgaattatgattgatattaagaatcagaaaacaggctgtgttttctgtgcgctgtggctcatgcctgtaatcccagcactttgggaggccgaggtgggtggatcacgaggtcaggagatcgagaccatcctggctaacatggtgaaatcctgtctctactaaaaatacaaaaaattagccaggcgtggtgatgggcgcctgtagtcccagctactcgggaggctgaggcaggagaatggcgtgatcctgggaggtggaggttgcagtgagctgaaattgcaccactgcactccagcctggacgacagagcgagactccatctcaaac

SEQ ID NO: 316162 - DNA, 362 bp, Homo sapiens
tcataggttcgcagggcaccagcacaggcctcccgggtagcatctttcttgctcttgcccatgaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagcgtcaccataaaacgacacatcctgcgaacctatgagggatcctctagacgacctcc

SEQ ID NO: 316163 - DNA, 159 bp, Homo sapiens
tgggtcttgggaagtggtgagcaagcatcttgccacaccttcacgctccttggggaggccaatcatggagccctccagtttggggacattcccaccagccacttgctattcaagcttcctcaggagctgctgaaacccaggtattatttagctttcctg

SEQ ID NO: 316164 - DNA, 5615 bp, Homo sapiens
  misc_feature (3)..(4): n is a, c, g, or t
  misc_feature (8)..(8): n is a, c, g, or t
ganntccnggaaccgggatgcctccagcagtgaggcggtcagctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316165 - DNA, 5867 bp, Homo sapiens
  misc_feature (60)..(60): n is a, c, g, or t
cccacctcctacctgggggacaaggtttcttcatatggtggttacctcacttaccaagcnaagtcctttgcgcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316166 - DNA, 3616 bp, Homo sapiens
tggaccatggttgatagcaagtacttgaaaccttgggaagtgaaaccatgggtaaggggggaactaccgtaactaattatgacccatcctgttcaacatctggggaccaaacatgccacttgacaaatactgtcagtaagaacatttgtagttagccttttcttaatgcacaatcttacatttctattttttttctcaccaacagtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316167 - DNA, 2484 bp, Homo sapiens
gagctcgtacccctgaaccatctatgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316168 - DNA, 1216 bp, Homo sapiens
ctctagacgatcccatggactctaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316169 - DNA, 1381 bp, Homo sapiens
ggttcatctctctgtcagatccctccctcaccacgtcttacaatctattacattgaaaatattactcttaaacaaaaatgactgtgcatgcacgctctcatctataatggcaattttaaatacaaggtgcacctttgttatttgtaaaccttgaaagaaataaacttatttttaaaattgccattatgaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316170 - DNA, 5747 bp, Homo sapiens
  misc_feature (60)..(60): n is a, c, g, or t
cccacctcctacctgggggacaaggtttcttcatatggtggttacctcacttaccaagcnaagtcctttgcgcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316171 - DNA, 5177 bp, Homo sapiens
  misc_feature (60)..(60): n is a, c, g, or t
cccacctcctacctgggggacaaggtttcttcatatggtggttacctcacttaccaagcnaagtcctttgcgcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaaggtgcaggttgagacgcaggccctgaaagggtgaagatagagcttctctgccacttcctaaacctgaatctattggcttctcctccagggaatgcaaaaacgtaggttttaggttatagacagagattttttggttaacataatgtgtttcaaattacagtaatttgtgccattttcaccatctttgccataaggtaaaacattggcttaactgttttctctccatcaaactatttattttaaatgtgcttctatgggatctttttatctctcccataaatggaaacccaatattctttaccataaataatagataaccctgagaaataaacatttgaaaaccaaacactgttaatatcaactaagtagtgtgacctatgtgttct

SEQ ID NO: 316172 - DNA, 5152 bp, Homo sapiens
  misc_feature (60)..(60): n is a, c, g, or t
cccacctcctacctgggggacaaggtttcttcatatggtggttacctcacttaccaagcnaagtcctttgcgcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggataggggttgcttggttctggtaaaaaaaaaaaaaaaaaaaaaaaaagtggaaacttactctagccactagagggagcctgcagggcccatcattttgatgttgtcgacgattccagatgcctgtgcaccattgcttgtcaagcaaactattttaggagcactgtccgctcctcacctccaccctcagccctggttcacaagagctccgggaatcttcaagccttgtcttccagagggaggtagtacattggcgtagagtccgtctctgctgctcaaccgtgccatcagccaggtgttcccgtgcaggatg

SEQ ID NO: 316173 - DNA, 4370 bp, Homo sapiens
  misc_feature (60)..(60): n is a, c, g, or t
cccacctcctacctgggggacaaggtttcttcatatggtggttacctcacttaccaagcnaagtcctttgcgcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctgggtgagtggaataatacttctgtcagagctgtgagtgagttttactctctttcgtttaatggaattttctggtgtctttttgcaaaatatttgtccttgataccaaaaatacttcactaataagtcttgtccttcttcctttttccatatcaatttcttcataaaaaaataaactgccacacatggtggctcatgtctgtaatcccaacaactaagaaggctgaggcaagagggttgcttgaggccaagagttcgagaccagtcttggaaacacagtgaaaccatgtctctacgaaaactaaaataaaataaaatgtaaataaataaaattttaaaaataaatcagttggatgg

SEQ ID NO: 316174 - DNA, 1035 bp, Homo sapiens
acctcacaacaacacagcatactcggattgccagaagaacgggtcagtctggatgcaaagagccgttccatacgcgttaggcaagcattctctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316175 - DNA, 845 bp, Homo sapiens
ttctagaggatccctaaaggcgagccgggtagcacttatgtgttacctgaaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcaatcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaattatga

SEQ ID NO: 316176 - DNA, 3207 bp, Homo sapiens
  misc_feature (3)..(4): n is a, c, g, or t
  misc_feature (8)..(8): n is a, c, g, or t
  misc_feature (3191)..(3191): n is a, c, g, or t
ganntccnggaaccgggatgcctccagcagtgaggcggtcagctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcctctctcttttggtagctctgaattcagtttgtatctcaccatgagcttgccatcttctatatttagagatatgaagcgatccccgttttctgcaaagaacagcaagcctctatccacggtggtctgaatgtctgtccaaaggttgggatgggagcatgtgntgagtgattcgcgacc

SEQ ID NO: 316177 - DNA, 2593 bp, Homo sapiens
  misc_feature (3)..(4): n is a, c, g, or t
  misc_feature (8)..(8): n is a, c, g, or t
ganntccnggaaccgggatgcctccagcagtgaggcggtcagctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaactaagtgtgcccacccgtgttctcctccaaatgctgtcgggcaagatagctccttcatgcttttctcatggtattatctagtaggtctgcacacataacacacatcagtccaccccattgtgaatgttgcctgtgtcatctgtcagctcccaacaatactttgggcttttggtctctcttgtccttttcttttccaaagttgtacatagtggtcaattggggctttaacctcctgaagtcttgagtttcatttttcaattttctcttcttcggttggattttgctgaataacaaccatttaggaatgctcaatggtgctggtgattcttt

SEQ ID NO: 316178 - DNA, 1788 bp, Homo sapiens
  misc_feature (3)..(4): n is a, c, g, or t
  misc_feature (8)..(8): n is a, c, g, or t
  misc_feature (1785)..(1785): n is a, c, g, or t
ganntccnggaaccgggatgcctccagcagtgaggcggtcagctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaaaaaaaaaaaaaaaaaaaaaaaaaaattggggggcgcgcgcgccgcgggccccccgagaaaagctcttttctagagacccctctcgcggttggggcggcgcggggacccacagatgtgaggtgataagtgtgaaacactgtgggccataaaggtgtggttcccacaaggaggaactccccggggacaagaagaacaaaggggtcgtgggggtttctctccaccactatttaaaaaagagcgccccgggggagacaaccgcagagtgtctgtctctgggaacaatatttcccaagtaggggagtttctccagagaaggagcgctataacgcggggggcatcttttataaaaacgggggagtgtcccaaacgagagagtctcccaattttaaaatattaaaccccccgcttgcgtgggggggncgc

SEQ ID NO: 316179 - DNA, 489 bp, Homo sapiens
agagtcaaaagagctgtctttggcatcagctttcagaagtcagtgtcttcatagaaagtagctgagatcacatgaaatcagcatggcctctggacacaggagaccagagcttaaatcccaactcttggtaaccaagccatcttgtcaggctcctcagtgagacacattctcttatctgggaaatggggaatgataatttcttcttcacagattcattttaagggtaaaattcattcatgtacgtggaagcactacctggtgtttagaggaagttaattgaatttatatctaagctgaccaaatttctgcaaacagcactcccacaggtctagtatgaaggagttaaaacaaagtcaatggtgtagacattaagcagggctcacctccgatgatagacctaaccagcctcctttccccagtcaccataaaacaacacatcctgcacctggaactggacacagacagtagctacacagctggacagatccc

SEQ ID NO: 316180 - DNA, 721 bp, Homo sapiens
agaaaaagaaaaagaaaagaaaagaaaagaaaaagtggttcataaaatgtgccatgacttttttggtactcttccacctcaatctttttgaaaattgctgccttgaactcctaaccttccctacaattacaaggacatggtatattctaatatgaggtggaccaaatatttattattcagaataaaattacattgcaagttaataatctcttacatttcaaaatcttcagctggcagaccacatcttcctaagcagacatttccaaaagggtatcttactcatctttgtcgagctagggtttgattgtcagagtatgagagcacatccaggagaaagagctggctgccttaacattttaaagatgtctcctctgctttaacaaaattatgacaactagattgcattttcttggctccatttttcagatagcaacatcttgtattaataagcacactggcatggtgatcatttgctgctgtgttctaatttatgatgattaatgttgacaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggtaatctataacaagcatccagatacaaccaaatatattcattctgtttagcaatttggagataac

SEQ ID NO: 316181 - DNA, 2241 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316182 - DNA, 2245 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggttaccattgtctttgctcctggtttcccgtaccagcagctggatgtcatgccgctgccagttttgagacgctgcagtgtgagggacctgtctgcactgaggagagcagctgccacacggaggatgacttgactgatgcaagggaagctggcttccagactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316183 - DNA, 2259 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316184 - DNA, 2141 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316185 - DNA, 1821 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316186 - DNA, 2159 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggcagctggatgtcatgccgctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316187 - DNA, 1974 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316188 - DNA, 1956 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316189 - DNA, 1389 bp, Homo sapiens
taggccgtgggacccagagctgagccatctcggtagaaggtcacctgagtcagtggccagtcttgccaggcctggagcgcaaaccagcatctgttgtggctatcacagtccaaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316190 - DNA, 993 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatgactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgagttcgcatcagagtgcaggttgt

SEQ ID NO: 316191 - DNA, 1689 bp, Homo sapiens
tgatgctgaaagcgtgttggccaaatctgaatgatgaaagccaattacaaactagaaaatgaaaacagaccccagatgcaaggagatgagacagttagatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactggctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaaacaaaaaaaag

SEQ ID NO: 316192 - DNA, 593 bp, Homo sapiens
ggtgaaagctgaccctgccggcccacagttgggctctcttctccgggagtggagaatacagtgagccgtgtattctcagccgtgaagctgagctcttgtctaatgcacgcccggccactcagacactctggcagaagccagtgctgtgggcggcctcccagaacggcggtggggctagcagtgtcgacgctggcctctgccccaggtcctggctggacacagctcacacgtgctgcctaggaatcaggtaaatctcacctctgctttatccacaggcagatggaagtctgatcagaacacaccctctgggaagcctgttagtaaaaggaggaagggtacccacatggaactacctagagtgagcctgttggcccatggcctggctgggcaaggtggaccccacagccactttccctgtccctcgccttgcagcggagtctattcccaggaggaactgagtgtagggtgttccctaatccctaacccaaggaagagcccccgaaaaggaccctgctcgtccccacttctgtctggactctggggagttttggaccttggtcgagccttctctagaccagatgggggtacagagt

SEQ ID NO: 316193 - DNA, 552 bp, Homo sapiens
gcgccctttttttctttttttaaatttaccatttgatttgatttattatattttgaggccaagactcgtctccatcgcccaggctggagtgcacggggcatgatctcaagcttcattgtgaacctcacacctccacccggtatcaataaattctcccgccgttcagtctccccagaagctgggattacagacgcccatcaccgtgccgggcttaattggtgtatttaagtagagacagggtttcactgtgttggcaggctggtgttgaactcctcccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaacgtgggccccacatgatagaactaaattcagatatcattaaataaac

SEQ ID NO: 316194 - DNA, 2334 bp, Homo sapiens
ccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgggggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcacttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaacgtgggccccacatgatagaactaaattcagatatcattaaataaac

SEQ ID NO: 316195 - DNA, 965 bp, Homo sapiens
aaaaaaaaaaaattcagttgatgtacttcaattttctgtgtaatttgcattggagtatgtgatttttctcatttttctaacagtttttcctattattttcatttctcaccttatttctttggctagaaagtccattatattattatttaaccaatggtgacagtaagtattccaattaataacatcttgattttttaaggtaaatgattttatagtttcacagctcagtgtcatgttggatgattaaagtagcatgttaaggacatatctatatatttttttaaagacagggtctcatggttactcaggctggagtgcagtggcatgatcatggcttactgcagccttggcatcctgggtttaggcaatccccccacctcggcctcccagagtgctgggattacaggcgtgagccactgtgctcagccaggacacctctttctattccaaatttagtaagagtaatcagaaatgagtatttaatattatatctgtcttttgtacacaattttgtaatcaaaatgagaaaactaaccttaggcaaggtgcttcccctcattatactgtatgcgatatattacaaagaaagcatttttccctttgtagtgaaaaataagtaaaacgtgtgattaattccctgcccatgtttacttggctctcttcggaaacattttcactagccaaatattcttacagtgtatagctccactctgatacatggatacattattgaattaatgagttaattaatgaagaaagtggtcttacaatggtgaacacatgtagtggataaggaatgacaggaaggaataagtcttttggatgaaagtgtgggagaccacagcataacgtgagaaaaacaaggatctcttcttccaaattattgcctaaacccaggcacttatggaagtgttgggctattaatagttcataaactgggatggcttagttccctgtgcctgtga

SEQ ID NO: 316196 - DNA, 1452 bp, Homo sapiens
gagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 316197 - DNA, 1534 bp, Homo sapiens
acagaatcttgccgcatgacccaggctagaatgcagtggtgtgatctcggccctctgcaacctccacctcccagacgttcgccatattggccaggctggtctcaaactcctggcctcaagtgatctgcccacctcggcctcccaaagtgccagcagcatgctcggaggagtgactttaaagcttttctacttgcttcctagaactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 316198 - DNA, 1281 bp, Homo sapiens
gagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatca

SEQ ID NO: 316199 - DNA, 1130 bp, Homo sapiens
  misc_feature (1)..(1): n is a, c, g, or t
  misc_feature (18)..(18): n is a, c, g, or t
  misc_feature (21)..(21): n is a, c, g, or t
ngctaggtacaggccggngtnaatcggccgaggtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 316200 - DNA, 941 bp, Homo sapiens
gagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagatctctactaagaatgtcactctggccgggcgcagtggctcactcctgtaatcccagcactttgggaggccgaggcaggaggatcacttgaggttgggagttcgagaccagcatgaccaacatggaaaaaccccgtctctactaaaaatacaaa

SEQ ID NO: 316201 - DNA, 1364 bp, Homo sapiens
  misc_feature (1)..(1): n is a, c, g, or t
  misc_feature (18)..(18): n is a, c, g, or t
  misc_feature (21)..(21): n is a, c, g, or t
ngctaggtacaggccggngtnaatcggccgagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 316202 - DNA, 1869 bp, Homo sapiens
gagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcaaaaaaaaaaaaaaaaaaaaaaagcaaaaaaaaagaaaacaaaacagaccacaaacaaaaaaaggagaaagaagacaacgaaaagaaaacaaagaagagccgaggagacgctcgagacagcaacaggcgcacgacgaacacgcgaaaagaggcacaggcaatggcaagcggcgggagaggaaggagccaaagagaggcagaaaaaagaaagcagaggcgcgaagacaagacggccaggaggggacgaggagaaaaggaaacgacggaagaagacagggaaggaggaacacgagagcgcaagaggcggcaaggagacaaagaagcggggagacgaggtggagagagagaaggagaggcaagcgagagaggagcgaaagaaagagggggaaaacagagagggcgagagacacacgggcag

SEQ ID NO: 316203 - DNA, 1251 bp, Homo sapiens
atttgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaaagggtcgagaaggcgggcggccagcctcgaggtagggggttattatcttccgctgcccgccgccccctcccacgccggcccaggctgaagttgactctgcccgcaggcctccaaagacttcatatgctccagatctcctacttccgcgacccctatcacgtgtggtaccagggcaacgcgtcgctggggggacacctaacgcacgtgctggaaggcccagacaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccgtcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggca

SEQ ID NO: 316204 - DNA, 1104 bp, Homo sapiens
gagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggtatgatgggacggggcccaggcctgcaagctggggagagggcgggttccagacaaatggatggacctgaaggatggatgcctagagaggcaaggaacggattatcccttagagcctttggagtgggtgtggccctgtcaataacttaattttagcccagtgaaattgatttcaggcttctgacctcccaaactgcgagagaataaatttctgttgctttaagccacttggtttgtggtaatttgttgcaggaatcacaggaaacgaatacagtgctcctgtgttgtatccagtctcgcttactgtcatctcctttc

SEQ ID NO: 316205 - DNA, 141 bp, Homo sapiens
tcccaggaccagcagcataatctgggagtttactgaaatgctgaatttcaggcctcccctctatctattgttttaacacgtaagggtaaggaattttgacattaggtttatgcctttcttcttctttttcttttttttgag

SEQ ID NO: 316206 - DNA, 6446 bp, Homo sapiens
gcagtgaagccaatatagttttattggatccaatgcactaccactaaaacaaatatatgtacactcaggccaatacacttttattaaaacaaatagaatttaattcaaaccagcattcaatacgttttctcaaagcaatgaaattaagctgtaccagtacttctgctcaatatgttttcccaatcaaatccatttgaacaaagtgaaatatatttatcatagatagcacatttttattaaaaacaaattcactgaaaccaagtttccctttgaactgatagatagaaattctaaccaattgcacaattagatcatagaaacggatgtatttttactttagcaaaaagcatttctgttcaggtccactttaaaacacactaatgaataataaaagttgctccaacaatgtctttaatggaatattctgtccaaggtatgtcctttgaggttgaagcacagtctagaaatttttttttaatgtagggaaaagaatagtgctgaaatagaattacaataacttcagatacttaatgactaaatatttatcctacctatgtgtacttaaaagtgatgttgttggatgtgtacaaatgaattaaagacatgcttgggggtgtcctttttagttgcatttgctactataccacattagccagaaaaaactttccttgtcattgatgaaaaacactctctcttcttacctgtctgaggttaactagggattgccatgcatagagagaacttaatggtatgggaggtcatttatttgtgtggctctttggagggaatttcaattttggtgcctagattacaaaccatattcaagtcttctgaagaaccatggaaaaggagaacaacttacaaatgccacacaccttttgggaggcaacaaactccctacgagcaagagtatccaaataacgtcccacctctctgcagggccactaatgctcccgacacacgggcagacctccaagtagagaagcatctctggagaaattagagcctccccacaaggaatatgagggctccgatcagtggccacaaggaacccctccctgctgcctccacagtggccccacactctgtcttctctgctcccatcttaccccaaggctgcaggaccttgggatagaaatcttctcccctaagcagcccagagaatgctccttaacccaagacagtgggttctcagtactacttcctccttcctgcctggaaaagtgcaaaaagtatagatatgcccacagttcactgggcaaataatgtactgacctccgggggatcctggccttgaatggactagatctgccttctctgaaacacaactggtcatggagggtaccctgcgaacagatgttcatcacagaattatttaaaaagatgaaatgttagaaacccaaatatctagcatccaggggattggttaaacatattgtaataatatcttcctgatgtattctacaatattaatatcaatacagtatcataagcattcagtgtcactgtagaggtatttaattgaatgggaaatattcatagtacattatcaaataaaaacgtttaaaagatatagtaatttcttatctttgcaaaatagatatgcatatctatgcataaacaaaaacatgggaagatgacactaaaatgttaatagtggtgagtgatagatgatagatttctctctctctctctctctccacctctctctttgaagctgtattttacaaatttcctgaaattcacctgtattacttttgatataagcaaaaattattttaaaagtggttattttttaaaatatggcattaagtccaatttaaaaggtagtgagcaaatgttgggtcggcttctgtagtcttaattctggtatcctttcagagagggtcagtactccacgtctcattctttgttcttttgcaaaactttatttgaaggctttcatcaactggtcattcgacatgcacttaaacaggaacccaggtaataaattctgccttgagtttgttccaggaagcagtgcggcttgacacaaaggatgtgcatgctttatgttgtcagatgatataaactgtgttgccccagattctgccttttgccttagctcagagccacctggctgttttaatcatctcatctcagatgcctggcaacatctaattcctcagctccttttcagtaatttcagttctattttcttactctatcattctggtgttttcattgcattttcttataaaagagatccagatttattttggaaatagatttgaatgacgaaaacatcctatagaagcaaatcctaaacaaatataaatatttgaccatgattatgcaaagaaagctcctgcttcctcctctgtgtcacagagaccctcgggaggaactccagggagaatggaagcttgggagtcatcccaacccttgctcaggtgcgaaatcccctgccctctgcctggcactgatagggacggatcagtttctctgcctggagaggcagcctcctgtgacctggatacattggagcctgaacacgggaacagaagggtctctgggaatccaatctcagtctgttgggcttacaaagtgaccaaagtcaaatgctggtctgtgagagaaagaggaggcagacacatcgggggaccgagaagtactttgaagcaccccgctcaccatggtatggggaagaatttggccacatccctgccaactgctgcttctcttggactgggaaagggtcagttgcttgtttctatcagattcatggacaccaccaagaaaagaggccagtctgagacattcaatatttgttgaaacacagaggtttaactgatcattgaggtacacagggtgataggaagagtatgaacttgagaatctgatggattttgtttaaagttaggactaggctactgactacccaccctgctaattgtcttggggaagttatttaacctctctgaacctcagcttctcatccacaaaataggacactagcacacagtgggctatctatatatatttattgaattgaaatgggagtattcaaaattatttgggttgttggcttaaaataagcagaataattcaattcctgttcatctggaatctaattgtccaatttggagtttcagatgtaacaaagatcctaatgacctaatattattggggtaatcctaaaatttattaggtgatctgcaagttccatgatgattgtatactggaggaaatgcacaatgcacacagaccttcctaggagtaaaagactgatgtgaatttgcagcactacttaattataagtaattgttgcatgaacacacacacaaacacacacccacagaactcacactataagataggggggcaaataatgacatttgacaaaaatgagctcttgcagagctcaacgagtctaagtttcctccctaatatcttaacaggctacagtatacacaggcttttaagtaatgtacttgttatccaaacactagcagacatttaactggaatccaggagcattttgtcaagaaggaaaagaactaaccaaagaaaaagaaaagtagagagtttcccagctgttttaccacatcacaacttcaaaaaaaccaagcctgtccttgccttgtccctgatggctctgccagcagagtgaatgaattggagcagatttaggttttaaaatgcctcctaatatcatttgggcagattagcttacatggctggacattgtgctcccagccacagggaatgttcttttcctgttggaagctctgacagccactgccacggtgaaatatcaggagcctcctaacatttttcttgatttctttaagagtgaacattagacatattaaaaacaacaacccaatcattaagccctgtgaggttttcctaggagccagctctatcgctttaatcagattacggacaactcattctcatcccagccatttatcttctttgtttacacacacaccaagtggcattcttcttagcatcaaaaaatagtaatcaaaattgagaacaacaaaagacctttcattatttacagtgttaagtaacatctatttgccttcattagtttctaaacaacgaagtacactggttctgattaaagctggcatgtgttaattatatccgaggtctgggattgttttgtctacaataaaggattgctgaaagctgaaatttgaggcgcccaggccccagaagtcacctgcctgtatgtgtttcctcagtgagagtttccagcctgagaatggcagaagcggatgtgagcttgtcacagaaagttttttttgctttgttttgttttgtttggtttttaagccctcggttttattgcccattttatgggctggagttaaatggaagtacaatgcagtttgctctcttactgctcagcactaacagccatgatgagccataattagaagtaaaaccaccacataaataacatggtagaaaaattgccacagtgagaagccagactttggcgacgggaaacttcagcgggtcctgagtatccatcatacttaaggggcaccgcgtattttagcccatatttgtcttactaaagccaaaatgggagccatttagactttcgaacaagcttttaaaaatagagaatgtaggcttaaacagactgcctgctgctaagtgtgatgaagaaacctgtcacctggaggctacgacagctggaagggctgggagggagagccctgggagcccaggggttaggaagggaagataaacaggagaggaagaggaggcctggactctccacaacagcaaggtctagacatttcactgcaaagcctaagagtctgcacaccgttgagcacagcagcttagacttccgccggggaacgtgtgaggctgggacgccttgcagattttgctttcatgacctgtactcagcgatgaagtgggagcaggtagactagtttttttttttttttttaatggagtctcattctgtcacccaggctggagtgcagtggcgtgatctcggttcactgcaacctctgccacccatgttcaagcgattctcctgcctcagccccctgagtagctgggattacaggtgcctgccactgcgtctggctaatttttgtatttttagtagagatggggtttcaccatcttggccaggctggtcttgaactcctgaccttgtggtccacccgcctcggcctcccaaaatgctgggattacatgcatgagccacgcgcccagcctagactagcatttttgagtacccactatctccttggcattttacttccattttaattctcataacagccttaggacgccaatgaaaaggaagagaaaataaagtgtgttctgtgcctgaaaatggccttaaagaaacaaggaccaacagctggagcagagtggggctgcccatacgcaaagagacaacaagtaggaattaacataaggcatatcacgtggatgccatagaactatcacagcaatttcttttttccccaagtcagcctctcttgtacaggggattagaaaacaaacccaagagaataaacttgaaatggaaggaacgtgctttgtagtcgagtgtttttcaaagcctgcatcattttaaaaactgatttaagtatattcatttgctttctaaaataagtcatatgtatgtttctactgatcggccagaatagttaaggtctgtctgatcttcatatggaatgaaaggggacattctttggatattctggaagtccacacgtgttctttacagagtttggtttgctttctccgtttcttccttcctttgcaaaatcaaacaaacaggaataaaaaccaaaccaaaacaaaattaatgaaaacccttgtgttgaggactttgttttgttttaaatgtgtctggtattaagcagtatgtttagtgaaatgactttaaacttaagtaggaaatacagctccatttcacacgtggattttgtctgcatttacatctctgcaggcctcacatgccgtgacaccagacatttttttaattaagatatgaagtgctcattttttttttgtggaactgctgtattctaacaaatttactacacgtctcagaaaacacatagctttgccaaagttggtgagtagcccagcatggtttatctccagcccacagctctttccctgaattcaatactgcaggcacaatttaatgcaaacccaatttatgacttaatgctctagggaccgtagtgggagattgttacattattcttttctaatcctatttgtgttttaatttgctaagtctgtaatgaggtgcatgccttgaatattcaagatctttcacattgcttttgactttgtttaatataatagattttacagtttgcattaaatacccaggtgcttcggtcagtattatctctttattttctcaactagagtgaataaaattacacgatgaaagt

SEQ ID NO: 316207 - DNA, 488 bp, Homo sapiens
ttctgccttttgccttagctcagagccacctggctgttttaatcatctcatctcagatgcctggcaacatctaattcctcagctccttttcagtaatttcagttctattttcttactctatcattctggtgttttcattgcattttcttataaaagagatccagatttattttggaaatagatttgaatgacgaaaacatcctatagaagcaaatcctaaacaaatataaatatttgaccatgattatgcaaagaaagctcctgcttcctcctctgtgtcacagagaccctcgggaggaactccagggagaatggaagcttgggagtcatcccaacccttgctcaggtgcgaaatcccctgccctctgcctggcactgatagggacggatcagtttctctgcctggagaggcagcctcctgtgacctggatacattggagcctgaacacgggaacagaaggtatcctccctccttccttagtggtctc

SEQ ID NO: 316208 - DNA, 6389 bp, Homo sapiens
gcagtgaagccaatatagttttattggatccaatgcactaccactaaaacaaatatatgtacactcaggccaatacacttttattaaaacaaatagaatttaattcaaaccagcattcaatacgttttctcaaagcaatgaaattaagctgtaccagtacttctgctcaatatgttttcccaatcaaatccatttgaacaaagtgaaatatatttatcatagatagcacatttttattaaaaacaaattcactgaaaccaagtttccctttgaactgatagatagaaattctaaccaattgcacaattagatcatagaaacggatgtatttttactttagcaaaaagcatttctgttcaggtccactttaaaacacactaatgaataataaaagttgctccaacaatgtctttaatgttaatgtagggaaaagaatagtgctgaaatagaattacaataacttcagatacttaatgactaaatatttatcctacctatgtgtacttaaaagtgatgttgttggatgtgtacaaatgaattaaagacatgcttgggggtgtcctttttagttgcatttgctactataccacattagccagaaaaaactttccttgtcattgatgaaaaacactctctcttcttacctgtctgaggttaactagggattgccatgcatagagagaacttaatggtatgggaggtcatttatttgtgtggctctttggagggaatttcaattttggtgcctagattacaaaccatattcaagtcttctgaagaaccatggaaaaggagaacaacttacaaatgccacacaccttttgggaggcaacaaactccctacgagcaagagtatccaaataacgtcccacctctctgcagggccactaatgctcccgacacacgggcagacctccaagtagagaagcatctctggagaaattagagcctccccacaaggaatatgagggctccgatcagtggccacaaggaacccctccctgctgcctccacagtggccccacactctgtcttctctgctcccatcttaccccaaggctgcaggaccttgggatagaaatcttctcccctaagcagcccagagaatgctccttaacccaagacagtgggttctcagtactacttcctccttcctgcctggaaaagtgcaaaaagtatagatatgcccacagttcactgggcaaataatgtactgacctccgggggatcctggccttgaatggactagatctgccttctctgaaacacaactggtcatggagggtaccctgcgaacagatgttcatcacagaattatttaaaaagatgaaatgttagaaacccaaatatctagcatccaggggattggttaaacatattgtaataatatcttcctgatgtattctacaatattaatatcaatacagtatcataagcattcagtgtcactgtagaggtatttaattgaatgggaaatattcatagtacattatcaaataaaaacgtttaaaagatatagtaatttcttatctttgcaaaatagatatgcatatctatgcataaacaaaaacatgggaagatgacactaaaatgttaatagtggtgagtgatagatgatagatttctctctctctctctctctccacctctctctttgaagctgtattttacaaatttcctgaaattcacctgtattacttttgatataagcaaaaattattttaaaagtggttattttttaaaatatggcattaagtccaatttaaaaggtagtgagcaaatgttgggtcggcttctgtagtcttaattctggtatcctttcagagagggtcagtactccacgtctcattctttgttcttttgcaaaactttatttgaaggctttcatcaactggtcattcgacatgcacttaaacaggaacccaggtaataaattctgccttgagtttgttccaggaagcagtgcggcttgacacaaaggatgtgcatgctttatgttgtcagatgatataaactgtgttgccccagattctgccttttgccttagctcagagccacctggctgttttaatcatctcatctcagatgcctggcaacatctaattcctcagctccttttcagtaatttcagttctattttcttactctatcattctggtgttttcattgcattttcttataaaagagatccagatttattttggaaatagatttgaatgacgaaaacatcctatagaagcaaatcctaaacaaatataaatatttgaccatgattatgcaaagaaagctcctgcttcctcctctgtgtcacagagaccctcgggaggaactccagggagaatggaagcttgggagtcatcccaacccttgctcaggtgcgaaatcccctgccctctgcctggcactgatagggacggatcagtttctctgcctggagaggcagcctcctgtgacctggatacattggagcctgaacacgggaacagaagggtctctgggaatccaatctcagtctgttgggcttacaaagtgaccaaagtcaaatgctggtctgtgagagaaagaggaggcagacacatcgggggaccgagaagtactttgaagcaccccgctcaccatggtatggggaagaatttggccacatccctgccaactgctgcttctcttggactgggaaagggtcagttgcttgtttctatcagattcatggacaccaccaagaaaagaggccagtctgagacattcaatatttgttgaaacacagaggtttaactgatcattgaggtacacagggtgataggaagagtatgaacttgagaatctgatggattttgtttaaagttaggactaggctactgactacccaccctgctaattgtcttggggaagttatttaacctctctgaacctcagcttctcatccacaaaataggacactagcacacagtgggctatctatatatatttattgaattgaaatgggagtattcaaaattatttgggttgttggcttaaaataagcagaataattcaattcctgttcatctggaatctaattgtccaatttggagtttcagatgtaacaaagatcctaatgacctaatattattggggtaatcctaaaatttattaggtgatctgcaagttccatgatgattgtatactggaggaaatgcacaatgcacacagaccttcctaggagtaaaagactgatgtgaatttgcagcactacttaattataagtaattgttgcatgaacacacacacaaacacacacccacagaactcacactataagataggggggcaaataatgacatttgacaaaaatgagctcttgcagagctcaacgagtctaagtttcctccctaatatcttaacaggctacagtatacacaggcttttaagtaatgtacttgttatccaaacactagcagacatttaactggaatccaggagcattttgtcaagaaggaaaagaactaaccaaagaaaaagaaaagtagagagtttcccagctgttttaccacatcacaacttcaaaaaaaccaagcctgtccttgccttgtccctgatggctctgccagcagagtgaatgaattggagcagatttaggttttaaaatgcctcctaatatcatttgggcagattagcttacatggctggacattgtgctcccagccacagggaatgttcttttcctgttggaagctctgacagccactgccacggtgaaatatcaggagcctcctaacatttttcttgatttctttaagagtgaacattagacatattaaaaacaacaacccaatcattaagccctgtgaggttttcctaggagccagctctatcgctttaatcagattacggacaactcattctcatcccagccatttatcttctttgtttacacacacaccaagtggcattcttcttagcatcaaaaaatagtaatcaaaattgagaacaacaaaagacctttcattatttacagtgttaagtaacatctatttgccttcattagtttctaaacaacgaagtacactggttctgattaaagctggcatgtgttaattatatccgaggtctgggattgttttgtctacaataaaggattgctgaaagctgaaatttgaggcgcccaggccccagaagtcacctgcctgtatgtgtttcctcagtgagagtttccagcctgagaatggcagaagcggatgtgagcttgtcacagaaagttttttttgctttgttttgttttgtttggtttttaagccctcggttttattgcccattttatgggctggagttaaatggaagtacaatgcagtttgctctcttactgctcagcactaacagccatgatgagccataattagaagtaaaaccaccacataaataacatggtagaaaaattgccacagtgagaagccagactttggcgacgggaaacttcagcgggtcctgagtatccatcatacttaaggggcaccgcgtattttagcccatatttgtcttactaaagccaaaatgggagccatttagactttcgaacaagcttttaaaaatagagaatgtaggcttaaacagactgcctgctgctaagtgtgatgaagaaacctgtcacctggaggctacgacagctggaagggctgggagggagagccctgggagcccaggggttaggaagggaagataaacaggagaggaagaggaggcctggactctccacaacagcaaggtctagacatttcactgcaaagcctaagagtctgcacaccgttgagcacagcagcttagacttccgccggggaacgtgtgaggctgggacgccttgcagattttgctttcatgacctgtactcagcgatgaagtgggagcaggtagactagtttttttttttttttttaatggagtctcattctgtcacccaggctggagtgcagtggcgtgatctcggttcactgcaacctctgccacccatgttcaagcgattctcctgcctcagccccctgagtagctgggattacaggtgcctgccactgcgtctggctaatttttgtatttttagtagagatggggtttcaccatcttggccaggctggtcttgaactcctgaccttgtggtccacccgcctcggcctcccaaaatgctgggattacatgcatgagccacgcgcccagcctagactagcatttttgagtacccactatctccttggcattttacttccattttaattctcataacagccttaggacgccaatgaaaaggaagagaaaataaagtgtgttctgtgcctgaaaatggccttaaagaaacaaggaccaacagctggagcagagtggggctgcccatacgcaaagagacaacaagtaggaattaacataaggcatatcacgtggatgccatagaactatcacagcaatttcttttttccccaagtcagcctctcttgtacaggggattagaaaacaaacccaagagaataaacttgaaatggaaggaacgtgctttgtagtcgagtgtttttcaaagcctgcatcattttaaaaactgatttaagtatattcatttgctttctaaaataagtcatatgtatgtttctactgatcggccagaatagttaaggtctgtctgatcttcatatggaatgaaaggggacattctttggatattctggaagtccacacgtgttctttacagagtttggtttgctttctccgtttcttccttcctttgcaaaatcaaacaaacaggaataaaaaccaaaccaaaacaaaattaatgaaaacccttgtgttgaggactttgttttgttttaaatgtgtctggtattaagcagtatgtttagtgaaatgactttaaacttaagtaggaaatacagctccatttcacacgtggattttgtctgcatttacatctctgcaggcctcacatgccgtgacaccagacatttttttaattaagatatgaagtgctcattttttttttgtggaactgctgtattctaacaaatttactacacgtctcagaaaacacatagctttgccaaagttggtgagtagcccagcatggtttatctccagcccacagctctttccctgaattcaatactgcaggcacaatttaatgcaaacccaatttatgacttaatgctctagggaccgtagtgggagattgttacattattcttttctaatcctatttgtgttttaatttgctaagtctgtaatgaggtgcatgccttgaatattcaagatctttcacattgcttttgactttgtttaatataatagattttacagtttgcattaaatacccaggtgcttcggtcagtattatctctttattttctcaactagagtgaataaaattacacgatgaaagt

SEQ ID NO: 316209 - DNA, 658 bp, Homo sapiens
tttcatcgtatcaccttacctctagcattcaggtatatattactttgtttattactctttgggtgtctatatctaattttaccaagtagtttgtaaacccctttaggcagtttttgtactttctgttcttaaaagagctattacataagctgcttaacaatgaatttaattggtacatactgattggttggttgaatttctttgatttggaagtaagtgttttaaacttagaatgcctagtgcaggcctctggtgttcacagatgtcctttcagtacttaaaaagtagtaatgttggccgcgcgtggtggttcatgcctgtaatcccaacactttgggaggctgaggcgggtggatcacgaggtcaggagttcaagactagcctggccaagatggtgaaaccccgtctctactagaaatacaaaaaaaaatgcctctgtagtcccagctactcgggaggctgaggcagaagaaatgcttgaacccgggaggtggaggttacagtgagctgagatcatgccactgtacttcagcctgggcaacagagcaagattccgtctaaaaaaaaaaaatagtaatgtttaggtgatatgaatgactgtttattttgagttaactgaaaaactattgatttagtacactaacactgaaaccttaag

SEQ ID NO: 316210 - DNA, 1916 bp, Homo sapiens
agcggtagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 316211 - DNA, 773 bp, Homo sapiens
agcggtagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagacagtgatattgatgatcctgaccctctgtaagcctaggctaatgtgtatgttt

SEQ ID NO: 316212 - DNA, 2178 bp, Homo sapiens
agcggtagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccactaaaaaaaaaaaaacaaaacaaacgcaacggaccaacagtggtcgcagcgcagcaggcacaccccaagaaagaagccttcataagaaccacagtcggatggggaaggggggggccaccaaacagagtatggtagaaaactggggacctgacagccgtccccacagagaacacccgggcgcacaacaagaggcgcgggattcaccccccattaaaaaaccgccggggaaacgggaggtcggacaacacccagaggacacaggcgg

SEQ ID NO: 316213 - DNA, 1555 bp, Homo sapiens
aatagggaagccattttctgtgtataaatcacagagaaattgactgtctaataaagaattgatctttggttttgtttttgaagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 316214 - DNA, 1760 bp, Homo sapiens
agcggtagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgtcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 316215 - DNA, 999 bp, Homo sapiens
gcacgagggtaaacatggcgctgtaccttaaatgtgcaccaagagcaaaggatcaacttttaagatttttacctgttttgggaaatacccaagtcttccttgtctctcaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaaaaacctaaatatatgatgaagattgtaggactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 316216 - DNA, 545 bp, Homo sapiens
ttttgttttctgatttgaggtaaaatcataaaacacagttcacaagaaaatacaatgactgtcttcccaagccccatgttcatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 316217 - DNA, 909 bp, Homo sapiens
agcggtagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaactgataagcctcagggacgatacatctggatcgcaatcatggtaccgtcctcggtttcacttggatccattccagttggctgctaagtttatactctttgccataatatctaatgtggtgggtcacaagacggggcagttggctcctcagaaagtcacgcggtcgcttgcttttacctctgtgtctgtatcaccagtcccataccctcagcaccc

SEQ ID NO: 316218 - DNA, 1862 bp, Homo sapiens
agcggtagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccgaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaaagcattcagtggaagtatatctatttttgtattttgcaaaatcatttgtaacagtccactctgtctttaaaacatagtgattacaatatttagaaagttttgagcacttgctataagttttttaattaacatcactagtgacactaataaaattaacttcttagaatgcatgatgtgtttgtgtgtcacaaatccagaaagtgaactgcagtgctgtaatacacatgttaatactgtttttcttctatctgtagttagtacaggatgaatttaaatgtgtttttcctgagagacaaggaagacttgggtatttcccaaaacaggtaaaaatcttaaatgtgcaccaagagcaaaggatcaacttttagtcatgatgttctgtaaagacaacaaatccctttttttttctcaattgacttaactgcatgatttctgttttatctacctctaaagcaaatctgcagtgttccaaagactttggtatggattaagcgctgtccagtaacaaaatgaaatctcaaaacagagctcagctgcaaaaaagcatattttctgtgtttctggactgcactgttgtccttgccctcacatagacactcagacaccctcacaaacacagtagtctatagttaggattaaaataggatctgaacattcaaaagaaagctttggaaaaaaagagctggctggcctaatggtggggcaatggttatttggttattttactcaattggttactctcatttgaaatgagggagggacatacagaataggaacaggtgtttgctctcctaagagccttcatgcacacccctgaaccacgaggaaacagtacagtcgctagtcaagtggtttttaaagtaaagtatattcataaggtaacagttattctgttgttataaaactatacccactgcaaaagtagtagtcaagtgtctaggtctttgatattgctcttttggttaacactaagcttaagtagactatacagttgtatgaatttgtaaaagtatatgaacacctagtgagatttcaaacttgtaattgtggttaaatagtcattgtattttcttgtgaactgtgttttatgattttacctcaaatcagaaaacaaaatgatgtgctttggtcagttaataaaaatggttttacccacta

SEQ ID NO: 316219 - DNA, 1327 bp, Homo sapiens
cctactgaaggggtctagaggttttctcaactaaagctgttctagaattttaaaaattaataacataattgagtttttcagcataaatttaaaatcatattttacacagattataaatttatttcaatcatgttttatgaatcaagttgaacattcttactaaactgaatttccaagtgtatttatttatttagagacagggtattactctgtcacccaggctggagtgcaatggcatgatcatagctcactgtaacctcccactcctgggcttgagtgagcctcctgcctcagcctcccgagtagctagggctacaggtgtgcacaatcatacctggctagttttttgttttttcttagagatgggaccttgctatgttgcccaggctgtccttgaactcccagtgtcaagcagtcctcccatcttggcctcccaaagctctgggattataggcatgaaccactgtgcccagcccatccacatgtattttaaatgatttttttttatttcactgaaagaggttatgaaacaggctctcacttaggacacctaagaaccaaagataatgtgtggactttgattgggcctggtgtgaaaaaacagctggaaaaggcattactgggataacggaacacttaaataggatctcagtattaaataatattaaataattattgacaattgttaattgtgataataataccgttaaacctaggtgatgagtttgaatgatggatttgaagcccagctcttgctttccagctttgtgagcttgggcaaattgtttagcttttgtgctttcgtagctgtttaatgacatagtatagcgcttgacaaaagtaagtgttcaatttattttttattgtaactaatattgcatgtttaatccccaggatttctggtactctctttttggtactttcttccatctcttgttacttaccttgattaggatcttgaatcaagaacttcctgggtctctattccaatacctttttcttaagaaactattccctcacctttcttattgacagaatagaaaaagagagctcttctttgcttttcctcttctctcattctccttcctggatttctggttaagaagaataaattagaataagcaaaacagttttgaggtaggacatatattttaatgattaactcaatcaaggtctgtgcagctttattctagcgacttattcctcttctcaagtttgtatattacagtaaaggtgaatggatacacacacacacacacacacacacatgtatttgtatatgtgtgcagaggatgttttcttaagaagaacctagatcatagagtgc

SEQ ID NO: 316220 - DNA, 1339 bp, Homo sapiens
tcagcatgcattggggattggttccaggatgcccgctataccaaaatctgcacgtactcgagtcccacagtcgaccctgcagaatccacagacaggaaaatttggctgttaggtttcgcatcccatgaatactgtattttcaatctatggttggaaaaaatccacgtgtaagtggaactgcacagtccaaacccatgctgttcaagggttaactgtagattgtcgtatactaatttgtatttccttgatttctaaagagttggagtctttttcatatttattgtctgtttatatgtcttcttttatgaattactcctttgggtgttttacaattatttaacggtatgtatatctttttctttttgatttagtttagtttagttttgagacagtgtcttgctctgttgcccaggctgtgtgcagtggtgtgattatggctcactgcagcctcaacctcctaggctcaagtgatcctcccacctcagcctcccaagtagctggaactacagaagtgggccaccatgcctggatatttttcttattttttaatagagactggggtctccctatgttgcccaggctggtctcaaacttctagtctcaagtgatcctatcacctcagcctcccaaagtgctaggattacaggcatgagccaccatgcctggccttttattcttttttaagagttctttgcatattacaaacttatctgccttctgtgttgcaaatcttctcagtttgtcattttctttggatgtttattatgaattttttcaatgtaattgcagtgtaatttatataatttacatacaataaaatgcatccatttaaagtatataattcagtgagttttgataaatgtgtaacaacataaccttgaccataaggaagatatagaatatttctgtcacctccaaaagttctcttgtgccattttatatggatctaatttccataattttaggttacttttttcctattcttggatttcatataaatgaaataatataatacatacttttccacaaagcatgattttgaggctcacccatgctgtcgtattagtagtttgttcctttttatcgttgtatagttttccattgtatgattatcattttgattatacatttgattatccatttgatttgattaatttgattatccattcacctattgatgaacaggaggtttgatttgatttgattatccattcacctattgatgaacaggaggtttttcagttttggtctcatgagtaaggctgatatggacttctgagtacaaatccttttgtggacatacattttcatttctcttgggtgaatatctagaagcaga

SEQ ID NO: 316221 - DNA, 1069 bp, Homo sapiens
gcaggagaatcacttgaacccgggaggtggaggctgcagtgaacagagatcacgccattgcactccagcctgggcgacaagagtgaaactctgtctcaaaaaaaaaaaaaaaaagaatagctgcctttgaatcatgttgaggattaaatgccatggtaaatgaaaacgctttgcaaacaccaatatgtcatacaacgggaaagttttattttctgactctttaaagttgccctgggtgatttggctgtctgcaaataactcaaagttaatgagtttattttttagagacagtgaggacctttcttttgtagtttaggtgatgtgtttgcatgctgctagatcacccactggcaatttggcagtttacaaagtcctttcttccacattatttcaactaggatgccattgggcaagttacttaaactctctccaaaccttagttttctaatctttaaatggtacagatacctactcacagggttttcgaggggattagatgggcatggtggctcacgcctgtgaccccaggactttgggaggctgaggcaggcagatcacttgaggtcaggagttcaagaccagcctggccaacatggtgaaaccctgactctactaaaaaatacaaattagccggctgtggtagcagatgcctgtaatctcagctacttgggaagctgaggcaggagaatcacttgaaccagggaggcggaggttgtagtgagccgagatcatgccactggctgcactccagcctggagatagaacgacactccgtctcaaaaaggaaaaaaaaaaaaaaagaaattaccattatgacttctgggcctttgagatttttgttgataaatcatgaataagcaccatcaaaaacacatcttttttttttttctccatggttatttcagttctaacctttgcgggttttaggagaatattgcctttgatgatgagttttacaagaagataatataatgacagaaaaggatatatgttagggacagtagtagagatgaagtgaggaacatgtttcccaagttttagtctattgtacactagcctgcctattttt

SEQ ID NO: 316222 - DNA, 617 bp, Homo sapiens
ttcaagaccagcctgggcaacatggcgaacaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcactg

SEQ ID NO: 316223 - DNA, 1831 bp, Homo sapiens
tacaagctctccgatagagaactttcaggcagatcccaccattagcctgtaaacaaaaggtttggcaccagccacctgggaccaaataagaattcaattgtgcttgtccagatatgaacaaatatgtagtgagtatagagtttaccataatcataacaaatattaaagatttccttggagtcagagtaaaaaacaaacaattataatgttgtctagggacgacatgatatgctacctcctttttcctgaagttttattccattatattgacaagatggagaaagcaagatcacgaaggtgtgcaaatgattcttaaggcatggacgaggatttttcaatttattttttaaactgtttccataccctttctttgtctttcttgctttttgtttttgccgttgtatttatgtttgagacacaaccagtcattggtggcaggggcatatagtggtcagtctgaaagggaggctctcttaagagctgtgtgccttccacccagagccttgtgggagacccagtagaaagaaacagcatcctgggaaatccagctaccatggccctcccagtggaggcatcttacatttaggatacttcaagtatcctcagaaatgtattctgcacccccggccccacccatgctgagggaaggggagcagttgccaatatttgcaccatcttcacatgcacctgttgcaacaagagcttctgggaaggtaagtggcattggagctagatcacgtttcacaattagtggttgttcttttctgtgtttgtcttgcactttaaaaaagagagaacacatgcaaatgaacttgcttgtgtgtatttgatggctctaagggctataaattacaaacaaaacacatcccagacattaggagttcataagtgtatttaatgaaattggtggttttaggaagtcaactttagttttgctttgtttgcatgtccactaatttttttattttgatatttgtcttttttttaaattttacagtagtcatcgaaagttatgtttctttgcttacttcatttttttctctaatcaagactggaacaaaagtataaatattatttatttcaggtagcatttttttcgtgtagttttttaatatatacttgaaggaaatgtttcaccttatttttggtctttgtttattcatttagaccctgcaagttgattctcattaattgtcagattccactaccctttcttcctcatagatagtaattaccaatgtaactaagtatttgtgttctgatatctgaggccagtaactattaatatctagttctcagagcatttggaaaggttatcttaaatggctacctaaattgaaatccttttcagaaaaaatataattgcaagtaggtaggactggcctaaattgtctaatgtaataaagtcagacaaaatgcatactttatagtttcaagattttcagtatataaaatctgtccattcccattaaaaagtggaagattttaaataatttctttacagatgttttatttaagcaggtagctcaatctactaatgttgtttgatctgtgtttgttatactggttgtaattaatttttttaattcatgaactagcagaaaatttattaaattaactattaactacattcaccttgtaaattactgtataaaacttgttgacaatgcactgactttagaaagatgttaatgtacataaatagagtgtaaataaaatagtgttgatgtaccgaaatatgaactgtataaaaagtattggtaattgtatatggggtgtacctgtttatctgtaactagtatacaaacaaattaaatactgtggatgcctc

SEQ ID NO: 316224 - DNA, 1872 bp, Homo sapiens
tacaagctctccgatagagaactttcaggcagatcccaccattagcctgtaaacaaaaggtttggcaccagccacctgggaccaaataagaattcaattgtgcttgtccagatatgaacaaatatgtagtgagtatagagtttaccataatcataacaaatattaaagatttccttggagtcagagtaaaaaacaaacaattataatgttgtctagggacgacatgatatgctacctcctttttcctgaagttttattccattatattgacaagatggagaaagcaagatcacgaaggtgtgcaaatgattcttaaggcatggacgaggatttttcaatttattttttaaactgtttccataccctttctttgtctttcttgctttttgtttttgccgttgtatttatgtttgagacacaaccagtcattggtggcaggggcatatagtggtcagtctgaaagggaggctctcttaagagctgtgtgccttccacccagagccttgtgggagacccagtagaaagaaacagcatcctgggaaatccagctaccatggccctcccagtggaggcatcttacatttaggatacttcaagtatcctcagaaatgtattctgcacccccggccccacccatgctgagggaaggggagcagttgccaatatttgcaccatcttcacatgcacctgttgcaacaagagcttctgggaaggtaagtggcattggagctagatcacgtttcacaattagtggttgttcttttctgtgtttgtcttgcactttaaaaaagagagaacacatgcaaatgaacttgcttgtgtgtatttgatggctctaagggctataaattacaaacaaaacacatcccagacattaggagttcataagtgtatttaatgaaattggtggttttaggaagtcaactttagttttgctttgtttgcatgtccactaatttttttattttgatatttgtcttttttttaaattttacagtagtcatcgaaagttatgtttctttgcttacttcatttttttctctaatcaagactggaacaaaagtataaatattatttatttcaggtagcatttttttcgtgtagttttttaatatatacttgaaggaaatgtttcaccttatttttggtctttgtttattcatttagaccctgcaagttgattctcattaattgtcagattccactaccctttcttcctcatagatagtaattaccaatgtaactaagtatttgtgttctgatatctgaggccagtaactattaatatctagttctcagagcatttggaaaggttatcttaaatggctacctaaattgaaatccttttcagaaaaaatataattgcaagtaggtaggactggcctaaattgtctaatgtaataaagtcagacaaaatgcatactttatagtttcaagattttcagtatataaaatctgtccattcccattaaaaagtggaagattttaaataatttctttacagatgttttatttaagcaggtagctcaatctactaatgttgtttgatctgtgtttgttatactggttgtaattaatttttttaattcatgaactagcagaaaatttattaaattaactattaactacattcaccttgtaaattactgtataaaacttgttgacaatgcactgactttagaaagatgttaatgtacataaatagagtgtaaataaaatagtgttgatgtaccgaaatatgaactgtataaaaagtattggtaattgtatatggggtgtacctgtttatctgtaactagtatacaaacaaattaaatactgtggatgcctccatgtgccgtttttcctcatacaagtaaacacagaaagaca

SEQ ID NO: 316225 - DNA, 666 bp, Homo sapiens
cggagaacactggttgtgcagttgaggcacagggtctagggccagacagacgtgggttccacccttgtgtttcacttgacgggagactctgagttagctatggagcctctctaaggttcatctgtaaaatgagaataggacttcacaagcctcctgtgaggatcacagaacatcactgcaaatgacagggcgtggggcaccagggggaccatgagactgagctcctgagtgagccgcttgcaaacaccatgtgaggagagcggagctcaggcggagggacatgccagtgggagatcacagggtggaaagtagctggtggtattcagccggtgtgggacaggtgtgctgagtaaaagggataattttacaggacgaggtcagtgagggaagcagagctgatcatgtccctctggagggcagtgaatgtaacccagcaaaaattagtgaaggaggaccaggcaccgtggctaacgcctgtaatcccagtcctttgggaggccaaggcgggtggatcaactgaggtctggagttcgagaccagcctggccaaaatggtgacaccccatctctactaaaaatacaaaaaatcagctgggcttggtggcacacgcctgtattcccagctactcgggtggctgaggcaggagaattgcttgaacccagaagg

SEQ ID NO: 316226 - DNA, 589 bp, Homo sapiens
taccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgctgcattggagggaacgtgacaggcaggtgtggaatagggacttctcttccggtcagagcaagggtcgtccgaaaccaaaacaaccctcttcccttcatctcgccccggatccaaagtctgggggctaggctggggcgggagtggcacggagatgtagggcgcccctttaagctgcgcacagaacgaaagaactcgttttttctttaagtgagtgtgcttgggtgacgcttagggcgccctccagcagtgcgcgcaggaaagcagcactgaggctccgagtcgctgatt

SEQ ID NO: 316227 - DNA, 227 bp, Homo sapiens
  misc_feature (120)..(120): n is a, c, g, or t
gttggaaagccctgtattaagttttgagaatgtctcagttttatttagacaagccctttacaaaggctaaaagttcacttgtttaaagcacaacaagaccttgaaaggtcaataatattntaccatcctctccccaccctccctatcggggtacttcactgtttcttttctacttgtgtatactcgagaaagggaagatggttaataaaagggatttgtgctgctga

SEQ ID NO: 316228 - DNA, 868 bp, Homo sapiens
taggttctccatttggatctcggcattttgatatgaaacttattagggcatgccgtctcattgaggactgtgcttgtcctctgcgtgcgatggtctgtggtggctctcctcctcacccagccagctcctcagagacctggacagctgcactagtgaccctgtggctgtggcctggcttgctttgtggacaggagtctgaggacgggcattgcctcagtcctcaggggttttgtggacattaacaagtaaaggattaaggtgactctgacatagggtcttccccaaggtcaggcacagaggaggtggcatccatgggacttagcatgttgtagaaacagagcatattgggacaaaagggacgttgaagatcacctggaatcctttagcgtccatccccatacattgggaccgacctagttcaatgaatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 316229 - DNA, 764 bp, Homo sapiens
taccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 316230 - DNA, 1046 bp, Homo sapiens
gaggtaggctgcaaatgattctcctatttctttccctgagttcagaacataggaattagattgatagacatcaacatacccgctttattgctgactcatgacaactaatgggaagacatggctcagatgtgcagccacagtgagcttctgaacatttcttctcagactaagctcttacacacagttgcagttgaaagaaagaattgcttgacatggccacaggagcaggcagcttcctgcagacatgacagtcaacgcaaactcatgtcactgtgggcagacacatgtttgcaaagagactcagagccaaacaagcacactcaatgtgctttgcccaaatttacccattaggtaaatcttccctcctcccaagaagaaagtggagagagcatgagtcctcacatggaaacttgaagtcagggaaatgaaggctcaccaattatttgtgcatgggtttaagttttccttgaaattaagttcaggtttgtctttgtgtgtaccaattaatgacaagaggttagatagaagtatgctagatggcaaagagaaatatgttttgtgtcttcaattttgctaaaaataacccagaacatggataattcatttattaattgattttggtaagccaagtcctatttggagaaaattaatagtttttctaaaaaagaattttctcaatatcacctggcttgataacatttttctccttcgagttcctttttctggagtttaacaaacttgttctttacaaatagattatattgactacctctcactgatgttatgatattagtttctattgcttactttgtatttctaattttaggattcacaatttagctggagaactattttttaacctgttgcacctaaacatgattgagctagaagacagttttaccatatgcatgcattttctctgagttatattttaaaatctatacatttctcctaaatatggaggaaatcactggcatcaaatgccagtctcagacggaagacctaaagcccatttctggcctggagctacttggctttgtgaccta

SEQ ID NO: 316231 - DNA, 3177 bp, Homo sapiens
gcaaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaaca

SEQ ID NO: 316232 - DNA, 4693 bp, Homo sapiens
gcaaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatggg

SEQ ID NO: 316233 - DNA, 5461 bp, Homo sapiens
gcaaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatgggaattctctttctagagaattatatccgggtaatgctacacacatggacttaaaatcctttttataaagtgtgagtcagtggcaggtcttatgtccaagtaattattacaaacaattttgaagcagtggaaatgtacagaacattctgatcattataatatataaaggcagtattactctcaaggttgataaaaatcaatgttctggagataactcatcactttttttgagtgaaaaagatcaacagaatttaattcaggaaatggtatctggagaatagcaaattgagaatatcagtgaaaagaatttagggatagttaactaggcatcacagtgaatttatttttggggactttgcatataaaatccttttaaccagttatgaaatgaaagatccattccccaaataagaaggcagcttccagtatctggtttctaggaaggagtaggactgtgattggtccctggtgccctgacttctgggcctgtttctgagccatgggggaccccccagcttcagaaatactcacgtgggttcacaccactccctgccccagaaggagggcaggcacaggtccatgccatgtggcctcagtgaagcctacagtaactatgggtagggctgcttttccctgtcaatcacccagggcacctgtgggtggacagaagattgtcatcggaatacatgcttgggcccaattatgggaataaaacctcatagaccaagagcagggaatgtgccagtaagtgttgagtctcccagctgctg

SEQ ID NO: 316234 - DNA, 4752 bp, Homo sapiens
gcaaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagaggttggtttgcagattattctccagtagtcatagagcatcagtagtatttcggagaatgtaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatggg

SEQ ID NO: 316235 - DNA, 4812 bp, Homo sapiens
gcaaccactaatataaacacctcccatgtataggaaggctggagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaatgagttgtccactgaattggggccaagcgttactgaagggtgtctggggaaagtttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatgatcttggccctgcacctaaagcggttcaagtacatggagcagctgcacagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagctatgccattcattatgtctggctgtattagaatgacatttcctatgaatgtctacggtctgttttaggtgtttgctaaacttctatggcttccagggtcttcttacaatgcattcctttaacttgtccctggaagcattgctacccattttcagcttctctgcctctcttctgatacaaggacagaagaattgggtagatattcaccttttaggggtgcaagtatagctttaagtttgtgcaagtgaaaatgttgaaaagtgagtaacctcgatattaaaatcatccttgacatgaaacagggtgaagagaagctgtccgtggcggctggtgttggctggcattggcactgggctgtgctgacctagccattacaattccaggggctaagaaggctcagggcagacaaagtcaagaggaggaagtttttgtggacaatgaaaagttattttcgtacctttctaccaaaaccaagtttcaggaaaataactctatgttgtttattttcagtgacacttatgtaaggccctgtgagttgtatttatcctgtatccggcactgctaagcttttcaaggtatctttccaatcctgctgatgtggcagtcaatggctgcagggctggcaaacctccccttagccagtcagcacggcattgttccttatcaggaataacaaaggtactacatctttccagccatcagcacgttgtacaacttaactttttaacatagtccgtctgtttactgaggcactggcgagtcccagggctgatacagaaccttccctagagggaataccagagttagctgggtatagaggtggctcaaaggaagtgtccgtgggcagggggaggaatgaacaaaatggcgctgtttctttggctcagactcctagaatgcttgacaagacagaatttttttggaagaacctcatctcactatagttacttttttcacttttgttatatatgtatttattagagcatttgaatattggtacctttaaaagggtcatttggtgttttgctgttgagctggtttttgagtcatagatcttggcttcctttagaagccacttaacttccatacactataataaactgtgaacatatttttgttacctaatgcatccactgatgaacatgcaaactttgggcataatgtgaactaaaattgaaatggaaaatgttagtggccattttgcaacaatgaagaggatagcactttatctagatgaaaactggatttcttatctttgaaatatcttgaactgtttattgctcagaacttaagtaagcatgccaacatttcgtttgtttatgcttgaagtgaaatgttttacttttcactggagaagacaaaacagggtgatcttcatgttattgttttatacaagtgatggaaatgtaccttgccttgtttagaggcaatttcacatttataaatatttttttttcctccatgaaacttacgcagtaatcactacctggaaggtgagttttgatctctttttaaggagaggcactttccaactgaaggtgattgatgtagggaaatgtttgtactatatagaatccatatatttgactgcaagttacaaagttttaagaacatgatggttggtctctaatatatttggaactgattcataagaaaagttattaaaattatctttgaaacacctcttgaagctaatttattagaaaaaatatttcagttggaaggctgtagaagtaatgtttaaatgctaagtcataagttcaggatatttcttttctatttggttgtgcaaaatgtttttcccagttatttaatcgaagtaattccttttaatagaaagagtcagttaaaattcagcattcatggatagatttttggaacgaaaaagggtaagtataagaaaatattgcaaacacattaaaacagttgtatggtgcaggaaaagaagattggaaaaagaccaaaacacacttctccagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatggg

SEQ ID NO: 316236 - DNA, 2018 bp, Homo sapiens
cagatacgaatcgagccggacccgcataggagcaacactccatcagctttttaaaatttagagctatctgctaattttttccctcttccttctcaataaatgaaacaaacactgggcagctgcaggtttctcccaatcatgtctctttatgtaaagacagtaacatgcaaacacttttagtttacatccctcattcacagtgtaaagcaggaaatggtgtgggagatgtgagaccattctgaggtcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttattttcatggatacccttaatttcatgggcatgcctaataatgatctatgttctaactggagcttagggcttattttagatattggagtgtagctttattacagatggattttatctttcaacattgcattttgatcaactttgtatattcacgtgtattaaaatattgtgcactaaatgttttgcccttgtttgctattatatggtcaaggcatttatcagcactattgtaatgaactcatgtaagtggcatgggtcagggaaaattatttcctacttttctgcctaattaaatttctgttttccagtattacattaatttatttttggcttccatttctgtataaccaaaatagttactgtatttgtgtggcattcctattattttgttgctaaaaatattgtagtttttatttaaaataatctgtaccttaattttttaaaatgtaaccaattcaagcactttaagcaataatgtcaatcttgtgaaattttaatcagtttaacaccctgcctctaaaattgtttgcaaaaaataaataaatgaataaaatgggaattctctttctagagaattatatccgggtaatgctacacacatggacttaaaatcctttttataaagtgtgagtcagtggcaggtcttatgtccaagtaattattacaaacaattttgaagcagtggaaatgtacagaacattctgatcattataatatataaaggcagtattactctcaaggttgataaaaatcaatgttctggagataactcatcactttttttgagtgaaaaagatcaacagaatttaattcaggaaatggtatctggagaatagcaaattgagaatatcagtgaaaagaatttagggatagttaactaggcatcacagtgaatttatttttggggactttgcatataaaatccttttaaccagttatgaaatgaaagatccattccccaaataagaaggcagcttccagtatctggtttctaggaaggagtaggactgtgattggtccctggtgccctgacttctgggcctgtttctgagccatgggggaccccccagcttcagaaatactcacgtgggttcacaccactccctgccccagaaggagggcaggcacaggtccatgccatgtggcctcagtgaagcctacagtaactatgggtagggctgcttttccctgtcaatcacccagggcacctgtgggtggacagaagattgtcatcggaatacatgcttgggcccaattatgggaataaaacctcatagaccaagagcagggaatgtgccagtaagtgttgagtctcccagctgctg

SEQ ID NO: 316237 - DNA, 834 bp, Homo sapiens
  misc_feature (741)..(741): n is a, c, g, or t
  misc_feature (744)..(744): n is a, c, g, or t
  misc_feature (756)..(756): n is a, c, g, or t
  misc_feature (784)..(784): n is a, c, g, or t
gcaaaactgaaagccggaccccaggccgccgcgctgccgcccggcctccccgccagcgcgccaccatgggcagtcccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaatcaggatgctgagggggaacaggattgctggccatgaattttaattgaatttttgacggggcaagctacgttacattatggcagaaaaaaagtgcaactgacatactacaaagagattttttaagtttaaaaaaagtttggatcttttggatttcttttttttnttngggtcttaatgngcttaaataacgctgaattataattagncacacaaataatgagagtttattttttttgctggctcactccaaatcagc

SEQ ID NO: 316238 - DNA, 180 bp, Homo sapiens
tatcttgcctgtgggcttgacacaggggttgctgggtgattgaattaacctctgacatcttctgggctgtgcaaaatgataagttcaaaaaaaaaatgcagccattagactccttctcattgtttcttccttgaagcctttgtaatctttcttaatgtggttaaattcaagttatttcca

SEQ ID NO: 316239 - DNA, 629 bp, Homo sapiens
tagagcaacagtggtgatttactcagaacaggaggaaaagccctgcattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccaagaattgtggctgagtatgctcaaagtagttcatccaggtcaagtggagaaacacaattgggaaatggaagagaaatcagcactgattatccagaaacattggagagggtacag

SEQ ID NO: 316240 - DNA, 695 bp, Homo sapiens
tagagcaacagtggtgatttactcagaacaggaggaaaagccctgcattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcaggtaaaaaaatttggtgaggggattgatgatcatagaatcttactagagtacagttgaattgaaatttaggtgatttttttttaatttcctagtatgtttcttgttatcttttcattttttttccatacgtttctgggtaccagcactccagtaaccagatgcactttcaaagcaaaggatgtaagacaggaatctgatgtgtcaaatatgcaatcctatccacttaataagatatttggggaggggccaagcctacaaagggagccaatgatagttatattatta

SEQ ID NO: 316241 - DNA, 940 bp, Homo sapiens
gctgaggatctcatcaccctaaatttattatgcagtaagtctgcctagtaattacaagattttgtaattatatcagtctttaagttgtaatgctttccccaaaatgtatcactattataatatctagttttatgcttataataaagcgacagtttctgtcataaacatctgctggtcgttttcttagtcctcttccttgttttcagatgggcactcatagtaacccatttagcagattgtacattctctcttttttttttttttttggaaactgagtttggctcttgtggcccaggtgtgaagtgcaagggggtgatctgggctcactgcaacctctgcctcccaggttcaagcgattctcctgcctcagcctcctgagtagctgggattacaggcgcacaccaccatgcccagctaatttttggtatttttagtaaagatggggttcaccatgttggccaggctggtctcgaactcctgaccttgtgatccacctgtctgggcctcccaaagtgctgggattacaggtgcgagccactgcacctggcctgtacattctttgaaaaggatatcataataaattattatatagtaaaaattaaccagactgttctaagaaatggaatgtaattagattaattaaattgtctggctaattgggtactaaaaccggaaaatccttgttgttcttgttcttgttaaaaatacatatgccaaaaataatagaaatgtccttttgtaattgaattttgtagcacttgaataagcatcaaggttttcctataggtatagaagatttggttgattatttgtgtgattcttttatgcataacctaaatggttatgtatacttgatgtcgagaatttgggaagtcctctaggacaagagtacgagatgatattataaattctgttatgagaaatgctatcaagggcaacc

SEQ ID NO: 316242 - DNA, 756 bp, Homo sapiens
aacatctttacacttagggtttgagtttctgtatctataaaaaagggtttggattaagtgatccctggcacttataaaatgttagggcttaatattattcatagatcgaggatagtttcattcttagtcgcctccttagtcactcttcctataccaatctgagaccattttacaatttagaaaagacaaataactggttgggttacttgatagtataataaccaagaaaaataattttagaaggaattaagtttgaaaccacatgttaacaaattctaccaaagtgggatttgcctgtgattaaagatgctgtaaacatttgggccagtagttataatttgaaaaatgtttatagccatatatataattttttatttaaatatacagtttcatcagtctattagtatttcattaagtctaagatgccatcagtggttagcaaacaccactgttttatgcactgctaagaaagaataaagggctgtgtgcagtggctcacacctgtgggacgccaaggcaggagcatcacttgaggccagaagttcaagaccaacctggtcaacattgtaagaccctgtctctacaaaaaaaaaaaagttaaaaattagctgggtgcggtggcacatgcctgtagttccagctactctggaggctaaggtgggaggattgctagagccacggtgttggaagctgcagtgagctgtgaccacaccactgcgctccagcctgggcaacagagtgagaccctgtttctaa

SEQ ID NO: 316243 - DNA, 433 bp, Homo sapiens
  misc_feature (45)..(45): n is a, c, g, or t
agggaccatgatgggaaaaaaccggaccatttttcccagagcccntttttaccctttgagtctagagagaagatgctaaggtactggacaatgatactgtatttgatttggggagtaaaaaacggggaaggaaatgaactttggcttttttccagtgggttattttccctttcaaggtgactgtgctgatttgtttgttttatcaattttatgcataatatgtgactgtaaaaccttatatatctcttaagtaactaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316244 - DNA, 6263 bp, Homo sapiens
gcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaaatctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaggaagtgtaatgtcagacacacaagaaaagcaaatcagtgttgtaagcttaaagtacaatttcaaaggtcattaccaacagcagggtttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316245 - DNA, 6091 bp, Homo sapiens
gcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaaatctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaagaggtggttcttggtcccggaacccacaagaaaagagccaatatcccagggttggtcagagctcttaaagagttggcaatttccaagggtccattaccaaacagagagggttttttttatatccatctttaaaaactttttggtctcctttatcctatggcccatttcccatatattgggggggtttgggctaaactccttattcacaagggcactccaccgggaacgggtcttccagcccattgattggcctttatttttttctaacacaggttcctaagagtgacggctcattcacatattgggttttatccccatgggctgactttggcacagagggtccttagttattccctcttggccagttgggttagtttttgcgtgggtaattccaacccaccgggtcgggtctaagggacagtcaacgtttgggacctaattccgaaactcatagtggcggctatttggtacccaggcgtggtgcatgtgttcccagtgatgagtgggaggtgaaaagaaatttggacctcttcgggggtggataagaagaacccttcttggttagggtaggagggatcacagatgggggtgaccaactaaggggggcacaagagaacaagagggtgggttcagggtttccaaaggatagggggtttaattacttttggttacctttctagaaagactggtccaataaacgtttttcaagtgatcaatttatggacaagttggtat

SEQ ID NO: 316246 - DNA, 5419 bp, Homo sapiens
gcccccttcttcccccgctggccccctccccggagggataatatggtctccggcgatggacgccccaaaagcaggatacgcctttgagtaccttattgaaacattaaatgacaagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaaatctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaggaagtgtaatgtcagacacacaagaaaagcaaatcagtgttgtaagcttaaagtacaatttcaaaggtcattaccaacagcagggtttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316247 - DNA, 5780 bp, Homo sapiens
cctcatcgggtgatgatagccaaggtggggataagtgtggtttcgaagaagatataaaatatgattagttctgtggctgtgaatgttataattaaggagatttgtagggagattagtatagagaggtagagtttttttcgtgatagtggtaatagtttatgcacagcataaactattgttactctaacttcattcctgttaacagtatatacactgtattttctgagatttaattaaattttgtatgtattttatgacttgcttttattcctttagcattacttttaatccctttagtaatagtttatgctgttattctggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaaatctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaggaagtgtaatgtcagacacacaagaaaagcaaatcagtgttgtaagcttaaagtacaatttcaaaggtcattaccaacagcagggtttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316248 - DNA, 4516 bp, Homo sapiens
agtcgttatatttttgaaatgtttcttagaccatctattctttgaattatttcaggaagacgtatgataatgtatagttattaatttctgtgtttatgtgaagaaaataaaatgtacaggtaattagttcttccagccgcttaagcctgaagcaccctgttgaatcatttacttgatttccatgatatgtctttgaaaaggtatgaacattttcagagttatttttttactgagtatcatgttcaaaaattttaaccaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaaatctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaggaagtgtaatgtcagacacacaagaaaagcaaatcagtgttgtaagcttaaagtacaatttcaaaggtcattaccaacagcagggtttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316249 - DNA, 3254 bp, Homo sapiens
gcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttga

SEQ ID NO: 316250 - DNA, 3750 bp, Homo sapiens
gagtaggagttactgattacatgcaatcaatatttggtgtaaaatgaatgtgagtagtgagtataacttccccaattaataagtcaaaatctaaatgcagctatttttctacttaactatgaagcccatggtcaggtatctcaggtgtttttcaagcagcagcaaagtttcaggcaatcagaatataagaaattagaaccaagataaatcagacagaatctgtggcaagtatagtcattaaatatgaagacaaatggtcttaaccatcaagtagcacctggaagatttacttgctcacatgagatgtttttgctcctttcaagacaagcactggaaaagtattcagcgtgattgcttcgtttgaagatgatgtggaaataacattatacaaacatggaggattattaaactttgtggcacgaaaattctcatagtatctacttaccatagatacctttcataactggtaactgcaaagccttttgtgctggacccaggaatccttaccatggagcagcagatagtcccagtatactcacttatctcatccatggatgtaaatgatgatgaatcaacatagtaactgaaatgaaatcttcttgattttaaataatatacgaatggtgctattaatattgctaaaatcaacgtgtgaagtgtgttgtggaagagacctgtaagtatgggggggggcgatattttatcagaccattttgtaaataaaggcagaatttgtgttgaagattcttatatgaataaccttcctggatttgtttagttttgcaccaataaaactgtgtactactgtttgttggtttaagagtagcagattgaaatataagaagccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccccaggtcacaatcattctgtccaatccagccaaggttccctccacatatgaagatggaccatggcaggatacaactgattgtgtggcaccatgtattagcagtgggaatatgtatcacatatgatgcagcctttcatatttcagcagtttgccactgtgactgtctggcaagcccccagatggcgttatattaattggattagattattttgctcaccttatgtaatactgtaacttcctataacctaatattttcggtatcattaaccaaaatttcacactcatagttgctaaagagaatgttattcaatcattaaactctgaactgatttcttctatacatttaaattatccaccctcaataatacgggtgctcaaccctatgcattttttaagtgttgctatttcttaattaaattgatttcctgtcattttgaatcatttatcacctgcgatgcatgattctattaattttgttatgttactgttttaaccaaagctgaccgtaaggataaaacacttaagttgttgctgagtactatatatcctcaatatgcatgtctgcccatcacatcaaatgttctgtcaacaagatgtttggtaattttttttaaaaaggttggaaaattaattatagaaggttctatactgtttttttaattaagaaactaaatctagcaggctaaaggttaattgtagtgattttttttcacatagatatctttctatgacctagttagttactgcaattcagaattagttcacattgcataaagaattacttgttgtaagcaaaatgctgaaactaccaaaccagtggatgaagaccactaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaggaagtgtaatgtcagacacacaagaaaagcaaatcagtgttgtaagcttaaagtacaatttcaaaggtcattaccaacagcagggtttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316251 - DNA, 1658 bp, Homo sapiens
cgattactttcaaaaagtgaatcgtgtttaaaatactactaaagaaaattactgtttccactgttctgtgaggtgagcatgtcaaaggtggggtatattcggcctctatcactgtgtcattcgtttatcttttgtcttctcttttagtggtcacactcgtgttgcaaagcctcctgagtagctgggactacaagcatgcaccaccacgcccagctaatttttgtagttttagtagagatggggtttcaccatgctggccagatgatctgaatctcttgacctcgtgatccgcccgccttggcctccacaagtgctgggattacaggtgtgagccaccacacccggcctatattgttttgaaagcatactctatatatagttatgggcagaggcacaggcatcctcagcagctgattcaggagatgatggtaaagctagctaactatgaattaaacattcacatatccagtctacctggtccagtaataatacaagcaaatcttgtatttcaggaacaaatcaaggttctcttaattttttggcttatatacaatgaagtaaaaacttgataaacatggtttcaaattgaggaggagagtcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaaaaaggaagtgtaatgtcagacacacaagaaaagcaaatcagtgttgtaagcttaaagtacaatttcaaaggtcattaccaacagcagggtttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtactagtatccctctagccagattgcttagtttttcgttggtaatcaaacaacagttgtactaaaggaaagtaaagctaggacctaaatcagaatcatagttgcctgcatatatggtaacaaggtcgtgtgcatttgctttcacagtgatgagtgagaggatgagaagaaattatttgacatttttctgtggttgaatagaagacacctttcttttgtctttaggtttaggaggagatactaagatactggatgtttatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcattgtctattatttaaagccaacaaaacagtgtaacagttttaagttcaataatgttaagtattgtatagaaatatattggaggcaaagttcagttgatgacaattgtgtatatgttactgatgctgtaaattatttttaataaagaaaattgtattatcaaaaaaaaat

SEQ ID NO: 316252 - DNA, 2864 bp, Homo sapiens
gcccccttcttcccccgctggccccctccccggagggataatatggtctccggcgatggacgccccaaaagcaggatacgcctttgagtaccttattgaaacattaaatgacagttcacataagaagttcttcgatgtatctaaacttggcaccaagtatgatgttctgccttactcaatacgggtcttgttggaagctgctgtacgaaattgtgatggctttttaatgaagaaggaagatgttatgaacattttagactggaaaaccaaacaaagcaatgttgaagtgccctttttccctgcccgtgttcttcttcaagattttactggaataccagcaatggtggattttgctgctatgagggaggcagtgaaaactcttggaggtgatcctgagaaagtccatcctgcttgtccgacagatcttacagttgaccattctttacaaattgacttcagtaaatgtgcaatacagaatgcaccaaatcctggaggtggtgacctgcagaaagcaggaaagctctctccacttaaagtgcagcctaagaagcttccctgcagaggccagactacctgccgaggatcttgtgattctggagaactaggccgaaactcaggaacattttcttcgcagattgagaatacacccatcctgtgtccttttcatttgcaaccagtgcctgaacctgaaacagtgttaaaaaatcaagaagtagaattcggcagaaatcgagagaggcttcagttttttaagtggagttcaagagtttttaagaatgtggcagtgatccctcctggaactggaatggctcatcaaataaacttagaatatttgtcaagagtggtttttgaagaaaaagacctcctcttcccagacagtgtagtcggcacagattcacacataacgatggtgaatggtttagggattctggggtggggggttggaggcattgaaacagaagcagttatgcttggtctgccagtttctcttactttaccagaggtggttggatgtgagttaactgggtcatcaaacccttttgttacatccatagatgttgttcttggtattacaaagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggttttagcaaagccaaactcgaatcaatggaaacataccttaaagctgtgaaattgtttcgaaatgaccagaattcttcaggagaacctgaatactcccaggtgatccagattaatctgaattcaatagttccatctgttagtggtccaaaaagacctcaggatagagttgctgtgacagatatgaaaagcgatttccaggcttgcttaaatgaaaaggttggatttaaaggcttccaaattgcagctgaaaaacaaaaggatattgtctccattcattatgaaggaagtgaatataagctgtctcatggatcagtggtcattgctgcagttatcagttgtaccaataattgcaatccatctgtcatgcttgctgcaggtcttttggctaaaaaggctgttgaagctggtctgcgtgttaaaccttatataagaacaagtttatctccaggcagtgggatggttacacattacctcagttcaagtggagtattaccatatctaagtaagcttggatttgaaatcgttggctatggatgttcaacttgtgtgggaaatacagcacccttatcagacgcagttttaaatgcagtaaaacagggtgatttggttacctgtggaattttatctggaaacaaaaattttgaaggtcgtctttgtgattgtgttcgtgccaattatcttgcctctccacccttagtggtagcttatgccatagcaggcacagtgaatatagatttccagacagaacctttaggtactgaccccaccggcaagaacatttacctgcatgatatttggcctagtcgagaagaagttcatcgagtagaggaagaacatgttatactatccatgtttaaagcattaaaagataaaatagaaatggggaataaacggtggaattccttagaagcaccggattcagttttgtttccatgggacttaaagtctacttatatcagatgcccttcattttttgataaacttaccaaagagccaattgcactccaggctattgaaaatgcccatgtcttattatatttgggagactctgtcacaacagatcatatatcacctgcaggaagtatcgctaggaatagtgctgccgctaagtatttgacaaacagaggccttacccctcgtgaattcaactcttacggagctcgaagaggtaatgatgctgtaatgacaagaggcacttttgcaaatatcaagctttttaataagtttattggaaaaccagctcctaaaacaattcattttccatcaggacagacgctagatgtatttgaggctgcagagctgtaccagaaagaaggtatcccactgattattttagcaggaaagaaatatggttcaggaaactccagagactgggctgccaaaggaccgtatttactgggtgtgaaagctgttttggctgaaagttatgaaaaaatacacaaagatcatttgattggaattggcatagctccacttcagttccttccaggagaaaatgcagattccttgggcctctccggtagagaaacattttctttaacatttcctgaagaactgtctcctggaattacattgaatatacaggtatctctaaatttttcaaatatatgat

SEQ ID NO: 316253 - DNA, 183 bp, Homo sapiens
tcacacataacgatggtgaatggtttagggattctggggtggggtaagtaaatgactaaatatatttcatttcttttggggtaaggatgtcaagaacattgtaaaagaacataaattattgagtttgtatagcctctttgaggctctgtgtttttcatctgtaataacagcagcaacaacaaa

SEQ ID NO: 316254 - DNA, 155 bp, Homo sapiens
cagcaatggtggattttgctgctatgagggaggcagtgaaaactcttggaggtgatcctgagaaagtccatcctgcttgtccgacagatcttacagttgaccattctttacaaattgacttcagtaaatggtacttcaatgcagatatttataga

SEQ ID NO: 316255 - DNA, 748 bp, Homo sapiens
ggattgctagagccacggtgttggaagctgcagtgagctgtgaccacaccactgcgctccagcctgggcaacagagtgagaccctgtttctaaaagaaagaaagaaaaagggctgccacctaaacagacacactattgagttgaggtaccctgatttcaaagacatgaaaatgttaattatagccaccttgagctttcaggcccctttctaccctgattaacagtgacattggaccagtcttctctttacttcttatcttaaaatacccccaaaaccagaatgagttgattcataaggacaatgaaggatctcattccttcaccatcactagtattggttaaaaattttattttatagttttcagacaatcgttgctaatcttatctttgcaattttgtatgtgtttctgtgtattccttatatagcacctcaggcaagtaggagtggctggaaagtttgttgagttttttggaagtggagtttcacaattatctatagttgatcgaactacaatagcaaacatgtgtccggaatatggtgctatcctcagctttttccctgttgacaatgtgacattaaaacatttagaacatacaggtaagaagataaaagatcactagaataaacatgttacatttccaatgtgtttgataatattttataaattactaccttatccatgttatttactattcacaaaattacattatgttgaaacaacaactttcaagcaaacatcagatgtct

SEQ ID NO: 316256 - DNA, 1694 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgag

SEQ ID NO: 316257 - DNA, 1015 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagtttt

SEQ ID NO: 316258 - DNA, 1045 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggcca

SEQ ID NO: 316259 - DNA, 831 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtggtaagcatgttagaaatattgagcctctgtaaaactcattttgttagcactcgggaagaccagttccagcaccaaagtaatttttattcaaactatttgcagttgttgtcatttaatttttatttacaggtttcataatgttaccagggctgatgtttatgggacccaaactaaattttgact

SEQ ID NO: 316260 - DNA, 574 bp, Homo sapiens
atgctatacctatatatataatagaatatatgcattttaaatctggattctttcagtgaatgctgtttgtgaggcccatctatcttgatgcatgtagttacaattattttttctcgttactgtgtagtattccgtgtttgtatataccccagtttatccagattagaactggtcttttaaaagtttggttatcttagagaaagaggtaaactgctgccataattgtaaatagaagtgttgttttttctctctaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggcca

SEQ ID NO: 316261 - DNA, 1931 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 316262 - DNA, 2648 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtccttggcctcctaaagtgctgtgattacaggtgtgagccactgtgtcctgctagtgattgtgattaacaggcctccagggaagtgccataagcccaagactgccgtactcaaaagtcagccatgtaggtaaagcaagatatttggtcaaggagttttagaaggagatttttcctgtggtgttggcttaagtgtggcactgttgtgcgtgtgtgaggtgtcttctgtgggaaggatttcaaacagtacaaagggatgtgatgtaagcatccagaactcactccagaaattgaataaaatgctagtagttagtctctaggggaacttttgagaaagtctcagtggattcctgaggcccaagaattgtgctaacaagcactcaaggcgattctggtacataattagggttcagacctcagctgattggtctactgttggtcaggaacaaaactgcaagtatactctgtttccagaaaatacgtttacctcttcacaaatgctaacacactgcaaaaatatgtttgtggaaagctgacttagtctcatctagcggttactctcttgccctgacaaagcagcaaataaagccattgctaacaattca

SEQ ID NO: 316263 - DNA, 2095 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagagaatataagaatactgacaatatcaaaagagtaactctgggcaaacatatggagctccataatgtgtgcccaactgctcagagtaacactgttctcaaatgtttaaaaaggacaggtgaagtctgggtctccttttttaaagcagacaccaatacttacataactagtacatgttggcctttcaccagcactcactggcactcacaggtgccttacataccttacgggggccaacactgacaggtattagtacgtcgcaagttgctgtaataatgtatttcctctcgttactgttgtgtcccccaagacacatgcaaattatttcctagacttcattcatcacagccagatgatgccaccagaagataccctccatggcatatggcacacctaagaggcc

SEQ ID NO: 316264 - DNA, 1671 bp, Homo sapiens
  misc_feature (1637)..(1637): n is a, c, g, or t
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagaggacacgaatgttcaggacacgaangttcaggacacgaaagttcagaccgaatgttcca

SEQ ID NO: 316265 - DNA, 1663 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaacgatgttcacgaatggacacgaatgtatcagggtacgagctcgattcgtatca

SEQ ID NO: 316266 - DNA, 1826 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatgattttcagttcacccactagaggcaaagacgtaagagagctaccagcgtattgagaggagatacacaggcactacgagaatggagtttagaagaaggtcagagccctgggcagtgttgggccaggctttagggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgag

SEQ ID NO: 316267 - DNA, 1696 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattaggccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 316268 - DNA, 1405 bp, Homo sapiens
aaatatacgggtagtctactgatgtagatgcttgtgtactactcattcccagcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgag

SEQ ID NO: 316269 - DNA, 1575 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggtagcggatcacgactatcacccagtcattgtcatctttatgcggaatacacagtgacaccagacacctaaatataaagcacattcctttgcgttctagtccgact

SEQ ID NO: 316270 - DNA, 1716 bp, Homo sapiens
  misc_feature (1549)..(1549): n is a, c, g, or t
  misc_feature (1559)..(1559): n is a, c, g, or t
  misc_feature (1631)..(1631): n is a, c, g, or t
  misc_feature (1645)..(1645): n is a, c, g, or t
  misc_feature (1664)..(1664): n is a, c, g, or t
  misc_feature (1685)..(1685): n is a, c, g, or t
  misc_feature (1693)..(1693): n is a, c, g, or t
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacttttttttgagaaagagtctcattctgtcgcccaggctggagtgcagtggcgcaatcttggctcacagtaacctctgcctcccgggttcaagcgattcccccgcctcagcctcccgactagctgggaccacaggcacgnaccaccacgnccggctcacctttgtatttttaagtagagatgggggcctcaccatattgggtcaggctgggtcttcaatctncctggacctcatgntccacccgccttgggcctnccaaaagtgcttggggattanagggaatngggccaccggggcttgggccaat

SEQ ID NO: 316271 - DNA, 1223 bp, Homo sapiens
atgctatacctatatatataatagaatatatgcattttaaatctggattctttcagtgaatgctgtttgtgaggcccatctatcttgatgcatgtagttacaattattttttctcgttactgtgtagtattccgtgtttgtatataccccagtttatccagattagaactggtcttttaaaagtttggttatcttagagaaagaggtaaactgctgccataattgtaaatagaagtgttgttttttctctctaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgag

SEQ ID NO: 316272 - DNA, 1640 bp, Homo sapiens
tcctgcagaccagagaggacgcacccccacccctaaacactttctggtgaggcggaccctgccccgcagccttcagcagatgagggaagctcccctccgagactctggatagccgccgggggggcgttgcctggccggctggttgcgtagcaacggcaggcggtgcgtgacgtgcgcagcgcgttccgtcctgaggcgcgcccgccccggggtaagctcgcgccgccgcgtcagctcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgag

SEQ ID NO: 316273 - DNA, 849 bp, Homo sapiens
  misc_feature (3)..(3): n is a, c, g, or t
  misc_feature (25)..(25): n is a, c, g, or t
gcngccgcctactactactaaattngcggccggtcgacttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgag

SEQ ID NO: 316274 - DNA, 740 bp, Homo sapiens
  misc_feature (3)..(3): n is a, c, g, or t
  misc_feature (25)..(25): n is a, c, g, or t
gcngccgcctactactactaaattngcggccggtcgacctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 316275 - DNA, 693 bp, Homo sapiens
tttttaagggatgatagggagtttcagctagagtcacagatttgccactatattaaatctctgctgctgagtacagatgataaggattgtattcaaagttgcctgataggagattggcaggggcagggtgaggctaggttacttaggtctacctggccaggtagacctaaccatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgactta

SEQ ID NO: 316276 - DNA, 1312 bp, Homo sapiens
tattgagtggccatgtgactcttcctttcacttggacacttgaggccatgctgggttattaattggcctaatttcagtatcattgtgtctcagggaatagagacactcaagagcagaaacataaatgggggaactactggtcagtggagcagcccgtgcacacacaacatttatcgattaagtttgcaatcgtatatgagtatgatttgtgctgctcccaatcaattgcaatgctaacatcaaagatcactaatcacatggccactcaataccggctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtccttggcctcctaaagtgctgtgattacaggtgtgagccactgtgtcctgctagtgattgtgattaacaggcctccagggaagtgccataagcccaagactgccgtactcaaaagtcagccatgtaggtaaagcaagatatttggtcaaggagttttagaaggagatttttcctgtggtgttggcttaagtgtggcactgttgtgcgtgtgtgaggtgtcttctgtgggaaggatttcaaacagtacaaagggatgtgatgtaagcatccagaactcactccagaaattgaataaaatgctagtagttagtctctaggggaacttttgagaaagtctcagtggattcctgaggcccaagaattgtgctaacaagcactcaaggcgattctggtacataattagggttcagacctcagctgattggtctactgttggtcaggaacaaaactgcaagtatactctgtttccagaaaatacgtttacctcttcacaaatgctaacacactgcaaaaatatgtttgtggaaagctgacttagtctcatctagcggttactctcttgccctgacaaagcagcaaataaagccattgctaacaattca

SEQ ID NO: 316277 - DNA, 1051 bp, Homo sapiens
tcgtttgtctggcagaagccctgattaaacataagcccagtgtaaagggcagggcacagcttggagtccaagctgtgccctgccctttacactgggctatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtccttggcctcctaaagtgctgtgattacaggtgtgagccactgtgtcctgctagtgattgtgattaacaggcctccagggaagtgccataagcccaagactgccgtactcaaaagtcagccatgtaggtaaagcaagatatttggtcaaggagttttagaaggagatttttcctgtggtgttggcttaagtgtggcactgttgtgcgtgtgtgaggtgtcttctgtgggaaggatttcaaacagtacaaagggatgtgatgtaagcatccagaactcactccagaaattgaataaaatgctagtagttagtctctaggggaacttttgagaaagtctcagtggattcctgaggcccaagaattgtgctaacaagcactcaaggcgattctggtacataattagggttcagacctcagctgattggtctactgttggtcaggaacaaaactgcaagtatactctgtttccagaaaatacgtttacctcttcacaaatgctaacacactgcaaaaatatgtttgtggaaagctgacttagtctcatctagcggttactctcttgccctgacaaagcagcaaataaagccattgctaacaattca

SEQ ID NO: 316278 - DNA, 1222 bp, Homo sapiens
acccgtcggatgaaagtgtcgtgggaaagagttacaggtagtggactcgtaacccttatgagcagccatgtggactggctccaagtaaagccatagggatgggactgccttaggccctgggggcctaatccccacctcagtctctccaggaagtagcacatgataacaagagattattttccagctttgaggtctgccctgctggggtttggactttcttggggcccattactcctttatcctggcctattttttcctttggccatggtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtccttggcctcctaaagtgctgtgattacaggtgtgagccactgtgtcctgctagtgattgtgattaacaggcctccagggaagtgccataagcccaagactgccgtactcaaaagtcagccatgtaggtaaagcaagatatttggtcaaggagttttagaaggagatttttcctgtggtgttggcttaagtgtggcactgttgtgcgtgtgtgaggtgtcttctgtgggaaggatttcaaacagtacaaagggatgtgatgtaagcatccagaactcactccagaaattgaataaaatgctagtagttagtctctaggggaacttttgagaaagtctcagtggattcctgaggcccaagaattgtgctaacaagcactcaaggcgattctggtacataattagggttcagacctcagctgattggtctactgttggtcaggaacaaaactgcaagtatactctgtttccagaaaatacgtttacctcttcacaaatgctaacacactgcaaaaatatgtttgtggaaagctgacttagtctcatctagcggttactctcttgccctgacaaagcagcaaataaagccattgctaacaattca

SEQ ID NO: 316279 - DNA, 454 bp, Homo sapiens
gtattgagaggagatacacaggcactacgagaatggagtttagaagaaggtcagagccctgggcagtgttgggccaggctttagggttagtattccgtgctttctgtctgcctcatggttttagttttactgtataaaaatcattatcaagaacctagggactacagccaggcatggtggctcatgcctgtaatcccagcattttgggaggccaaggcaggcagatgacttgagcccaggagttcgagaccagtctgggcaacatggcaaaaccccatctttataaaaaaatacaaaaattagctgggtgtggtggcatgcacctctagtcccagctactcaggaggctgaggtgggaggatcgcttgagcccaggaggtcagggctcctgcagtgagccatgatcacatcactgcactccagcctggatgacacagagagaccttgtctcaaa

SEQ ID NO: 316280 - DNA, 446 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316281 - DNA, 501 bp, Homo sapiens
  misc_feature (12)..(12): n is a, c, g, or t
  misc_feature (39)..(39): n is a, c, g, or t
  misc_feature (48)..(48): n is a, c, g, or t
  misc_feature (81)..(81): n is a, c, g, or t
  misc_feature (124)..(124): n is a, c, g, or t
  misc_feature (130)..(130): n is a, c, g, or t
ttttaggccacnttctctggggctatgaatccacgtggntgactgggntttattatcaatagtgagatcctcatcttcctncccgtttcctctcccatcctcatcccccacactgggatagagntgaggnctggtggctcggcaggttcgaggcgattcgactccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316282 - DNA, 395 bp, Homo sapiens
  misc_feature (1)..(1): n is a, c, g, or t
  misc_feature (39)..(39): n is a, c, g, or t
ncgagaagacgacagaagggggagggtggcgtcggcagnttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316283 - DNA, 325 bp, Homo sapiens
cttttcaaatccaaagcaccattttggggaaaaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316284 - DNA, 863 bp, Homo sapiens
  misc_feature (12)..(12): n is a, c, g, or t
  misc_feature (39)..(39): n is a, c, g, or t
  misc_feature (48)..(48): n is a, c, g, or t
  misc_feature (81)..(81): n is a, c, g, or t
  misc_feature (124)..(124): n is a, c, g, or t
  misc_feature (130)..(130): n is a, c, g, or t
  misc_feature (623)..(623): n is a, c, g, or t
ttttaggccacnttctctggggctatgaatccacgtggntgactgggntttattatcaatagtgagatcctcatcttcctncccgtttcctctcccatcctcatcccccacactgggatagagntgaggnctggtggctcggcaggttcgaggcgattcgactccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaaaaaaaaaaaaaaaaaaaaaaaaaaaaaagggaaaaaaaatgaaaaaaaaaaaaaaaaaaacccaaaaaaaaaaaaaaaaaaaaaaaaaaanactttgtgggccgcttggcccaagtcacttttaatttggggaaggttttggctgggggccgaatttggggctaattggcccatttcgccctttgggggggggtataaaattaactggcccgcggtttaaaacgggggggctgggaaaaccctgggggtacccaaatttataggtttggagacacatccccttttgccaggttgggtaaataggagaagagccgaaacggttggcctttca

SEQ ID NO: 316285 - DNA, 324 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaaatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316286 - DNA, 822 bp, Homo sapiens
  misc_feature (593)..(593): n is a, c, g, or t
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaacaaaaaaaaaaaaaaaaaaaaaaaaaaaaaaaaaaaaaaaaaaaaaaaaaaaaaaaaaaagggaaaaaaaatgaaaaaaaaaaaaaaaaaaaccttgtggcccggctgggccaatngaattttaaattgagccaagttattcattgcgcccgaaattaagctcaatgggccatttcgccttatggggagcgtattaaaataaccgtgcggcgtttacaacgtgggacttgtccctggggttcccaacttatcgccttggagaaattccctttccccagctgctaaataccaaagagccccacggacgcttttccaaattggccaccttaatgggtggttttgcgt

SEQ ID NO: 316287 - DNA, 560 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaaaaaaaaaaaaaaaaaaaaaaaaaaaaaaaaaaaaaaaaaaaaaaaacaaaaaaaacaaacaaaaacaaaaagggggggggcgc

SEQ ID NO: 316288 - DNA, 485 bp, Homo sapiens
gacctcgaacctgccgacgccaccagctcctcacccgagcgctgaaccccggtcgcagttcggggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaacaacaaaaaaaacaaacaaaaacaaaaagggggggggcgc

SEQ ID NO: 316289 - DNA, 790 bp, Homo sapiens
  misc_feature (561)..(561): n is a, c, g, or t
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaaaaaaaaaaaaaaaaaaaaaaaaaaaaaagggaaaaaaaatgaaaaaaaaaaaaaaaaaaaccttgtggcccggctgggccaatngaattttaaattgagccaagttattcattgcgcccgaaattaagctcaatgggccatttcgccttatggggagcgtattaaaataaccgtgcggcgtttacaacgtgggacttgtccctggggttcccaacttatcgccttggagaaattccctttccccagctgctaaataccaaagagccccacggacgcttttccaaattggccaccttaatgggtggttttgcgt

SEQ ID NO: 316290 - DNA, 645 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaaagtatccactggcagccgagaggcagtggtacccgcaggggtgcttggcgtgaggcaggcaactcaatctgtgttgtcggatggttttagttaaacccgggagagggggcggatggggtcctggcagatggtattctgccctagaatgtcctcttcctcgttctaccgcttccatttgccttaactgctctgcgcccagcacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316291 - DNA, 725 bp, Homo sapiens
ggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaaagtatccactggcagccgagaggcagtggtacccgcaggggtgcttggcgtgaggcaggcaactcaatctgtgttgtcggatggttttagttaaacccgggagagggggcggatggggtcctggcagatggtattctgccctagaatgtcctcttcctcgttctaccgcttccatttgccttaactgctctgcgcccagcacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316292 - DNA, 626 bp, Homo sapiens
ggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaacaaacaacaaaaccaccacacaaaaaaaaaaaaaaaaaaaaaaaaaaaaaaacaacaaaaaaaacaaacaaaaacaaaaagggggggggcgc

SEQ ID NO: 316293 - DNA, 716 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaaagtatccactggcagccgagaggcagtggtacccgcaggggtgcttggcgtgaggcaggcaactcaatctgtgttgtcggatggttttagttaaacccgggagagggggcggatggggtcctggcagatggtattctgccctagaatgtcctcttcctcgttctaccgcttccatttgccttaactgctctgcgcccagcacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaacaacaaaaaaaacaaacaaaaacaaaaagggggggggcgc

SEQ ID NO: 316294 - DNA, 1536 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactgtatcctttgtgtgactttttgaggaagcatctacatacccagcctcggttatctgttcaaaactaaagtctgcatgagcttatgcatattaagtgtttaacttaatacgtggcacatggtgagcacttagaaaatgggagctaggtaattatttggttggggaggagagtggttggtgaaatagtttgacttcaagttcaaaatatttattactgacctccacctgagtgctggacagtaggtcagggtggggtgagactcaggcatatctattgtgcaaaaggagcagaaactttttacaatttttattttatttatttatttttttgagacagtctggctctgtcgcccaggctggagtgcagtggcacgatcttgacccactgcaacctccacctcccgggttcaagcaattctgcctcagcttcccaagtagctgggattacaggtgtgtgccaccactccctgctagtttttgtatttttagtagagatgaggttccaccatgtatgccaggctagtctcaaactcctggcctcaagtgatcctcccgcctcggcctcccaaagtgctgggattatagccgtgagccactgtgcctggcctagaaggaacagaaacttttttttttttttttgagatggagttttgctcttgttgcccaggctggagtgcagtggtacaatcttggctcactgcagcctctacctcccaggtttaagcgattttcctgtctcagccttccaagtagctgggattacaggtgcccaccaccacacccagctaactttttgtatttttagtagagacagggtttcatcgtgttggccaggctggtctcaaactcctgacgtcaagtgagccacctgcttcgtcctctcaaagtgctgggattacaggtgtgagccactgcacccagccagaaattcttttgtaaagttttggttctctccaaataaaaatggcctggtccaaaatgggcttccttagccctgggctgagacctcaggccacctgacccggctgtgaatggatgagaggggtggggacggaagtcagagtcaggattccttaacacctttccttcagatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316295 - DNA, 465 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtgaaatgtctctttttcttaggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316296 - DNA, 700 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaagtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgccaaaataaaacaatataacaagaagaaataaaaaaccttgtgttgggcggctctgggccctctcggaagaaggtttttttaagagaacccacttccgggttatgtggggaagggccgcggggcccccccaagataggggcttacagaggtgatccacaccctgtgggggtcccaaatacccgggggtctcccccattaggagggaaaacacctccgtgggggacccaatgtgacaaaaggaggggcctgtggcacattttctcacaccaccactatgatttaaaaaacaacggcccccgcgggggggacaccaccccagcaagacgcgggttctctg

SEQ ID NO: 316297 - DNA, 602 bp, Homo sapiens
ggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaaagtatccactggcagccgagaggcagtggtacccgcaggggtgcttggcgtgaggcaggcaactcaatctgtgttgtcggatggttttagttaaacccgggagagggggcggatggggtcctggcagatggtattctgccctagaatgtcctcttcctcgttctaccgcttccatttgccttaactgctctgcgcccagcacggatgataccatcggggaccttaagaagctgattgcagcccaaactggtacccgttggaacaagattgtcctgaagaagtgacatgcaagcccggtaggtgcaagcccggtacatgcaagagtacatgcaagcccggtacatgcaag

SEQ ID NO: 316298 - DNA, 1212 bp, Homo sapiens
ggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgttaattacaggaactttagaatgttggcacacacaaaaacaaaagaaaaaaaaccctgcggaggcatctcttgtgtgtccgggtgtgccggaaaacaaggaggatcaagtgcaagagtggccacgtgtggccccattagccgtgtttccctgtggaccccgagcctttttcgtgtgttacacaggcggggactagaactccgtgcgcggaatctcccctttaatgagggaagcctcgctattaaactttcgcgagattagaccccgaggtttaaccctgtgccttttagagtgaaactccgggacaaagagccaaaacagcaagcgacccagcgcccaaacaagacgacccacacgaagcagagcagcggacgaagccagaaggcacgcccgacgaggggccaccaccgaccgcgacaacagcggaccgaaccgagaaccacgagaacaggggcagcagaggaggagagacacgaaggaacgacagtcagagcgcgggcggaggagcaggatggggaataaccccgaagacgcaagcgagagaggagccgggcaggcggaggcgacgagcacaggagcgggcaaacgcaagcaccgacaagagaaccacgccgatctgccgaacggagtgagagagagccgggcgaagcacgcggagagaagagagcgacagcccgcagggacgga

SEQ ID NO: 316299 - DNA, 526 bp, Homo sapiens
ggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttg

SEQ ID NO: 316300 - DNA, 597 bp, Homo sapiens
ggcctcgaactttaacttccgcttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaacaacaaaaaaaacaaacaaaaacaaaaagggggggggcgc

SEQ ID NO: 316301 - DNA, 517 bp, Homo sapiens
ggcctcgaactttaacttccgcttccggttcctagcgttaactgcgaccggggttcagcgctcgggtgaggagctggtggcgtcggcaggttcgaggcgattcgagctccagctaggatgatcgaggttgtttgcaacgaccgtctggggaagaaggtccgcgttaaatgcaacacggatgataccatcggggaccttaagaagctgattgcagcccaaactggtacccgttggaacaagattgtcctgaagaagtggtacacgatttttaaggaccacgtgtctctgggggactatgaaatccacgatgggatgaacctggagctttattatcaatagatgagaatcctcatcttcctgccccgctttcctctcccatcctcatcccccacactgggatagatgcttgtttgtaaaaactcaccttaataaagacttagatgttgaaaaaaaaaaaaaaaaaaaaaaaaaaaaaaacaacaaaaaaaacaaacaaaaacaaaaagggggggggcgc

SEQ ID NO: 316302 - DNA, 654 bp, Homo sapiens
taaattcgcggccgcgtcgacaaactttttgagattcactttacatatacacacaaatatatttttctttaccttttgaatttggagtaaaatctagttttatgtttgcttgaaacaacatatataatggagataataaaataactttttttcatttagactgatctcacaatgctgaaattagcagcattagaaagtaataaaatccaggacctggaaaagaaggagggacgtatagatgatttgctcagggtaagtaatgagtcatagaggggaaaaaaattgaataaattatttggcaacagtcaaactgttcagaaaatacttagcattgtaaaaaaatctgtagctaggccaggcgcagtggctcatgcctgtaatcccagcactttgggaggtcgaggcgggcagatcacaaggttgagagatcaagagcatcctggccaacatggtgaaaccccgtttctactaaaaatacaaaaattggctgggcatggtggtgcttgcctgtagtgccagctacttgggaggctgaggcagcagaaatgcttgaacccgggaggtggagattgcagtgagctgagatcacgtcactgtactccagcctggcgacagagtgagactctgtctcagaaaaaaaaaaaattctgtagc

SEQ ID NO: 316303 - DNA, 1718 bp, Homo sapiens
ttcttcccatcactgtaaaacattgatgcatgggtaaaaatatcttttttatatcgcaaataaattgagcttgttatagtcccctctcttcattttcaggaagaggcagaaatccaggcagaacttgaacgtttggaaagagtcagaaatcttcacatacgtgagctgaaaagaataaacaatgaagataattcacagtaagtcattatttgcatttcacagtttcatattattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattgctttggccaggagttcaaaaccagccttgtcaacatagtgagacccccatttctttaaaaaaaaaaaaagtctctgcttcttcatttcctcttttaatatcgttaccttgctttatattttctggatgttgatcactatctggaattataaatttattttttagttattatttgtctcctccctctagaatgtaagcttcatgagtgcaaggacttggttttgttcttgctgtatccgtaaagcctagaccagtgcctgacatatggcaggcacttaataaatatttgaataccaaagttaatgttatagtagtgaaggagaaattatttcaaccaaaagtatttcagtaagccatgtatcccacattatgcaagaattgggagagaaatggaaaagtacagcttacagtctgtgttcttaatcagttgtcagaatgagtgccatagatagtatatgttgaagcaattgaaagaaaagaaaatatctgtgggcttgtgggagcttcatgaaaaagatagaaattgagcaagacatagaagtagaaattaagcaaggtactacttggatttagttgatgtacaagagaggaaaggtttctgtttacacttcatctttgactggtcatgtagtttaaagcttccatgagttaatataagtatcagaataggaagtggccaatttctgtgtgaaatatgaaaatcttgcttagaaaggtcttcttgtgatgtctatgtatgtataattcataaatacacagatcattccattgtgtgaagagaaagaaatagttatggaataacctaaattatgtcagattaaaattctaatgaaagccaggtgtgctggcttatgcctgtaatccttgcactttgggaggccagtgcaagcaaattgattgagcccaggagtcaaaaacgagcctcagcaaggtggaaaaaccctgtctctacaaaaaatacaaaacttagcagggaatggtggcatgcacctgtagtcgcagctacttggggaactgaggagggaggatcgcctgagcctgcagtgagcctagatcgcagtccagcctgattgacaaagtgagactttgtctcaaaaaaaaaaaaaaa

SEQ ID NO: 316304 - DNA, 5766 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcaggggttccccaacctcccggtcttccagtccttggcctattgggaaatgggtcgtacagcaggaggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 316305 - DNA, 4702 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcaggggttccccaacctcccggtcttccagtccttggcctattgggaaatgggtcgtacagcaggaggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaatactacatggtaa

SEQ ID NO: 316306 - DNA, 5232 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcaggggttccccaacctcccggtcttccagtccttggcctattgggaaatgggtcgtacagcaggaggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaatactacatggtaaaaaaaaaaaaaaaaaaaaaaaaaaaaaaaaaaaaaaaaaaaaaaaaaaaagaaaacaaaaaaaaaaaaaaaaaaaaaaaaaaaaaaaaaacaaaaaaaaacaaaaaaaaaaaagcgaggggggggagagagaagatatgtacttgaagagggggagaaggagaagagagagtaaagaagaagtaataagatagtagagagatgaaggaagaaataaatagttgagtagttagatatatagtagagaagaagaaaacgagtgtatagaacaacaacacaaacacaaagagaaaaagacaaaaaaagagaaagaagaaagagaaaaaaaaaaaaaaaacaaagaaaaaaaaagaaaagaaaaaaaaagaaaaaaaaaaacagagaagaagaaaacaaaaagagagagaaagagaaaaagacaaaagaaaataaaggaagaagcagaaagaagaaaaaaaaaacaagaagacaagaaacaaaaaagaggaagaagaacaaaaaaagaaaagaaagaagacgcaacaaagacac

SEQ ID NO: 316307 - DNA, 5703 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 316308 - DNA, 5163 bp, Homo sapiens
ggcagagcttcttggatccagactatgaagctcatccattgcaccttccctgggcctcccggatggcggcgtgtgattcagcaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 316309 - DNA, 4360 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgta

SEQ ID NO: 316310 - DNA, 4236 bp, Homo sapiens
ctctgaccgatattggcacctgcaaagagaaacaaccagtaacaggcagcagcagcatcagtattaatcttccatgatgaaatctttacaggtcaagaacaagtacacagctcttttctcactccttcacagtggaccatgcaactagttgaaatggaagacaatggattgtctacaagccttttgaacagtggagaatgcagggcgttggctttaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataattttgagcagtgaaggaaggatgactgcctgttacacagaaacaggaataccatgttaagatagaggaaaaaaattttgtttatttgggggaacactgtaaataacgtttataatacttaaatacatttggttgttactagagagttctaatatgaagggtagtttttcattatttaaaaacacatggaaaaatatgagacatatttctaacatacgaactatagtgcctggatacattcttcagcatttggcagttaatctgctgaaaccaaagtaagaactgaatgacagtgacagttgtgttttatagtaatagaatgtgagagttagaatctttggacaaagttaggctttgtcatttgcctattcagacttttaccaagttgtacctcgagatcacatgtccgttttctttcactggttatattaaagggagagctattatttctaaatactttacacctttgacaaaatgagctgcttgtgttgaaatcagttgaattcactaaattataatattgccagtgttttcaacacgttagaattgataacaggtatttttcttttgttaccaggccttgttcatcaaaacaggtgacagtgagtaaccaaatgcagaccagttctatgcaggataatgataaattcccttctagctctattgtaaattgttgtacagatgtcatatttcaattactaagtttcagcagcttattcttgtacaaatgtttaaaatatggcttttctaattggatattgtattttttttaagtcttcttgaaggcactctaattgctgctaaatgatgttgcttctttgctaaaaaattaaatgacctagaaggtgcaagttgactgtacatcatagatattaaaaagcagacagtcattaacaatcaagatgtaaaagtgatccatgttggacataattgagtttttaaatcagtttattgggttctagggctgtagaacacatagatactagatttttaatttgttcatggttattctacatttctagaaagttcttatcagcaagatggtcccataagcaaatttcttgtggtttgtacagatttgttaaaatgtgaacgttttctaactgcctcgtagggtagaaaccaatatttttcaggatgctgtatttcactcctgtaaggactttttctttattgtcacattcataatgctgatacttacatgtaagttgttcatgttgcagaaaaaggttatacgtaccacggattctctttaatattgtacagttaaactgtatttctgatgttgcaagccattttgttttttcattgtacatagacacattgtctctttaaaatgctgctgaaattgtagagagtatagccaaaacagtaataaacaatgacagttaaaatgtaaagactatgaaaattacattggaagggagctttcaagatggtaggatattgactaactgagctccttcacttaaaaatcagctgaataaattccttaagtatacttcaagacaagtgtaaattgtttcaagctgttaaagttaaacctaataaccattatcaaggcaactcctgggtaagtaacacttagaaccatcaagagtggtttaaggggctggctatacccattcctctgtagagcacagagaaatcctattaaaaaaaaatactacatggtaatgaaatcttagcattgattgagtgctttacgtgctgcctgcaagttttcagttttgttgttagagttttcgtctttatgaatgataaagtcctatgttcataaagtaacatttaaattcctgaactaaaaggaaatgcctgttgtgcttaaaattttggggagatacgaagtgaatgtgtaaatctaactttgaggttcagtaagttaagtagtatagacctagagatcactgctttaccattttactttcaaatgaatgagagcgactgctagtggcagaacgcagaaaaggggaaaaacaagccatgaaatgaagttgctttcctgacctgggtttaggtcatcattttaaaatcaaagatgtgtaggagatgaatcaacttatagacccatattttccttctaaaagtttcccaaagaaatgttatagattttgaataacatgccagtgacccagcaggtccaagatggctaaccaagatggctaatttagccacattgaataacttacttttaccctcacatggaaagttggtatctattgctaaatgatttcaaggtcactctgacagtctttgacactgttttttttagggttttattgttttctggtctcctggtgtctgtcctcagaattaaagcatgtcctgcatccctaagatgatagccaaggcctctcttttattaagagtcagcactgatgtagggtaaaatcaacagtttttgcatatgattttaaaatctttctttgatttgaatttgctttagtgtgtgcatgttgagaggaagtaagtgtagaaaccaccctaatttgtaagttgggagttggagatacttggtggtttttcaaaaataaagactcaatcttttttttttttttaaacactcactaccatctccttctaaaacaactctgtcagtttaaatggcatataaaatgtgaacaaacacctcattacatgaagtcaaaatggtgaagagcttcagtgaaacatttaaagagtatattgtgtgttgttttgctgttcatcattacttattaaatgcagtaatgttgattgcc

SEQ ID NO: 316311 - DNA, 3028 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtagttggaaaagagccaccaaagatttccaacaaggttgatgtatggtcggttggagtcatcttctttcagtgtctttatggtagaaagccatttggtcacaatcaatctcaacaagacattcttcaagaaaatacaatattaaaagccacagaagtccagttccctgtaaaaccggttgtaagcagtgaagccaaggcatttataagacgctgtttggcatatcgaaaagaagatcgatttgatgtgcaccagctggcaaatgacccataccttctcccacacatgagaagatcaaattcttcaggaaacctacacatggctgggctgacagcatcccctacacccccttcttcaagcataattacttactgactttcctccaagattggcatgatatctttgaatttgcttccagatgcacacttaagtttgagagcatttgagtgtttgttttctttttcttttttttttttttttttttacacaagacgtggttaagaactgtttgtgaactgaagttcctcatagtgtcatttgtatgagagaggatcatggacaatgaataaatgcacacttctgactataaaaaaaaccatcaattttatccataaaaggcatacaaaaaaatactcatcaaaaaaaaaaccttgt

SEQ ID NO: 316312 - DNA, 2540 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagttcaaagatcacccaacattaaatgaaagatatttattacttcatctgcttggtagaggtggctttagtgaagtgtataaggcttttgacctttatgaacaaagatatgctgctgtgaagatacatcagcttaataaaagctggagagatgagaagaaagaaaactaccacaaacatgcctgcagagagtatagaatacacaaagaactggatcaccccagaatagttaaactctatgattatttctccttggatacagatacgttttgtacagtgttagaatactgtgaaggcaatgacttggatttctatctgaagcaacacaagttaatgtcagagaaagaagctcggtctattgtaatgcagattgtaaatgcactaagatatctcaatgagatcaaaccccctattatacattatgatcttaagccaggaaacatcctactggtagatggaacagcatgtggtgaaatcaaaatcactgattttggtctgtccaagattatggatgatgatagctatggtgtagatggaatggatctaacttcccagggggcaggcacttactggtatttacctcctgagtgttttgtaggtggtatcagtcctgataccaccacatggattaaatttcaaattaatgtatataatcccatagagccctacataattaagtcatttaaagtctgataaacagcttttagttttaacataataataattagtcatttttcagtgtaaaaaagtcaaaattatc

SEQ ID NO: 316313 - DNA, 3303 bp, Homo sapiens
gcctcagccgccacccacagcccgccgccgccgcctcccgggcgacgccgggggccgacgcactgcagaggtgccggcaggttccgcccgcggaagtgtcctcggccggcgcagcccgcgctccgcccgcgctccgaccccggcccggctggcaccccctcgacgcctccgccgccgcgctcctttcctcctcctctcctctggcgcgcccgctcgctccctcgcttctccccctttccctcctccctgtcccctctccttccctcacctctttcctccccacctcccctcttctcggtttcctcccccatccccttgactctcccctcccagccctcgctctctcgctcgccctcagcgcggcccccgccatgacggaggcgggtgccggtgccgttgccgccgctgccgtcgcagggggggagtcgggttcccagaaagtagcttgatgagtgtccaaagtagcagtggaagtttggaggggccgccatcttggtcccagctctccacgtctccaaccccgggctcggcggcggcggccaggtccctgctgaatcacacgccgccatccgggaggcccagggaaggtgcaatggatgagcttcatagtctggatccaagaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagacaccggagaagaaacaatcggaatcatccaggggaagaaagagaaaagcagaaaaccagaatgaaagtagtcagggaaaaagtattgggggacgtggccacaaaattagcgactattttgaataccagggtggaaatggctcaagtccagtaagaggcatacctcctgcaatccgttctcctcaaaattcacattcacattccactccttcctcatctgttcgaccgaatagcccttctcctactgcattagcatttggggaccaccctattgtacaaccaaagcaattatcctttaaaattattcagactgatctcacaatgctgaaattagcagcattagaaagtaataaaatccaggacctggaaaagaaggagggacgtatagatgatttgctcagggctaactgtgatctcagacggcaaatagatgaacaacaaaaattacttgaaaaatacaaagaacgattaaataagtgcatatcaatgagcaagaaacttcttattgaaaagagtacacaagaaaagctgtcaagcagagagaagagtatgcaagatcgattacgcctcgggcactttacaacagttagacatggcgcttcatttactgaacaatggacagatggttttgcatttcagaatcttgtgaagcaacaagaatgggtgaatcagcaaagggaagatattgaaaggcaaaggaaacttctagccaaacgcaaacctcccacagctaataattctcaggcaccctctaccaattctgaaccaaaacaaaggaaaaacaaagcagtcaatggagcagagaatgatccctttgttagaccaaatttaccacaactgttgactttggcagaatatcatgaacaggaagaaattttcaaacttagactaggacatctcaaaaaggaagaggcagaaatccaggcagaacttgaacgtttggaaagagtcagaaatcttcacatacgtgagctgaaaagaataaacaatgaagataattcacagtaagtcattatttgcatttcacagtttcatattattaaaactacccccgccccccatagagcataaacacaatatttccttcttgggttgtctcatcgtacttagaaaagatccaaagtccttcccatggcttggaaggccttttatgatttggtccctggccaccttactgtcctcacttctcttaaacatgtcaagagcattcccttctcagtgggcttttgtgcttaccatttcctctgcctggatgttcctcctctaaacacctaattggcttaattacttatctcactccaaatgttctttagaaaggccattcttagatcatcctatttaaaatagtagtccctagccaggcccagtggtgctcacctatagttccagctactcaagaggctcaggtaggaggattgctttggccaggagttcaaaaccagccttgtcaacatagtgagacccccatttctttaaaaaaaaaaaaagtctctgcttcttcatttcctcttttaatatcgttaccttgctttatattttctggatgttgatcactatctggaattataaatttattttttagttattatttgtctcctccctctagaatgtaagcttcatgagtgcaaggacttggttttgttcttgctgtatccgtaaagcctagaccagtgcctgacatatggcaggcacttaataaatatttgaataccaaagttaatgttatagtagtgaaggagaaattatttcaaccaaaagtatttcagtaagccatgtatcccacattatgcaagaattgggagagaaatggaaaagtacagcttacagtctgtgttcttaatcagttgtcagaatgagtgccatagatagtatatgttgaagcaattgaaagaaaagaaaatatctgtgggcttgtgggagcttcatgaaaaagatagaaattgagcaagacatagaagtagaaattaagcaaggtactacttggatttagttgatgtacaagagaggaaaggtttctgtttacacttcatctttgactggtcatgtagtttaaagcttccatgagttaatataagtatcagaataggaagtggccaatttctgtgtgaaatatgaaaatcttgcttagaaaggtcttcttgtgatgtctatgtatgtataattcataaatacacagatcattccattgtgtgaagagaaagaaatagttatggaataacctaaattatgtcagattaaaattctaatgaaagccaggtgtgctggcttatgcctgtaatccttgcactttgggaggccagtgcaagcaaattgattgagcccaggagtcaaaaacgagcctcagcaaggtggaaaaaccctgtctctacaaaaaatacaaaacttagcagggaatggtggcatgcacctgtagtcgcagctacttggggaactgaggagggaggatcgcctgagcctgcagtgagcctagatcgcagtccagcctgattgacaaagtgagactttgtctcaaaaaaaaaaaaaaa

SEQ ID NO: 316314 - DNA, 333 bp, Homo sapiens
atcagcggcagcgttagattctccataggagtgtgaaccttattgtgaactgcacatgcaagggatccaggttatgcactcccttatgagaatctaatgcctgatgatctgaggtggaaccgtttcatcccaaaaccatctcccctactccccgcagtctgtggataaattgtcttccacaaaactggtccctggtgccaaaaaggtggggaactactgatcttatggactagattggtcatatgtccattccaaaactagttacgaccaacagaggtactattgccttaaaaaaaatcaggccatctgtaggtggatagtgtcagaaattta

SEQ ID NO: 316315 - DNA, 432 bp, Homo sapiens
cccaacctcccggtcttccagtccttggcctattgggaaatgggtcgtacagcaggaggtgagcagcgggccagtgagcattaccgcctaagctcggcctcctgtcagatcagcggcagcgttagattctccataggagtgtgaaccttattgtgaactgcacatgcaagggatccaggttatgcactcccttatgagaatctaatgcctgatgatctgaggtggaaccgtttcatcccaaaaccatctcccctactccccgcagtctgtggataaattgtcttccacaaaactggtccctggtgccaaaaaggtggggaactactgatcttatggactagattggtcatatgtccattccaaaactagttacgaccaacagaggtactattgccttaaaaaaaatcaggccatctgtaggtggatagtgtc

SEQ ID NO: 316316 - DNA, 342 bp, Homo sapiens
gaaacatggttttatgttgactgtgataattttgtatattaaaactgtcatttaaaaatctgttatcttgttttctgtagacaccggagaagaaacaatcggaatcatccaggggaagaaagagaaaagcagaaaaccagaatgaaagtagtcagggtaagcacataacatcttccttcagagcctagtggacacttaaaattaattgttttaatttttaaccaattaatactctaattgtaaaataatatgaagttgtaaattttggtgtgtgcacaggtagttagtgtataatgattgcttttaggcttttcaatgttgcccttattgttttcatttggg

SEQ ID NO: 316317 - DNA, 200 bp, Homo sapiens
tgggattacaggtgtgagccaccatgcccagcctacaagcactttttaagcctttgctggttccatctgctcatgtcccattggccaaagccagccacgtgtccaggctcccttgcaagcgcaggagaaattgacacaatgggaagagctacaggggatgtgcagcccttctttgcaccaaccacacagagcctgagtat

SEQ ID NO: 316318 - DNA, 2291 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316319 - DNA, 2260 bp, Homo sapiens
gcgtaggtcaggcgggattaatcggcacgaggccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316320 - DNA, 2266 bp, Homo sapiens
  misc_feature (21)..(21): n is a, c, g, or t
tccgagtcagacaactatacngctaggtacgaggcctgccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316321 - DNA, 1953 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccaaagtgctaggattacaggcatgagccaccatgcctggccatgccccaaatttgaccagagaatcaaggaagagatcaaaatgtatagatgttccaatgctccagatgactttgcagtaaagtatataaggggtcttcaaaaagttcctggaaaatgcatattatgaaaga

SEQ ID NO: 316322 - DNA, 1479 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcaggctcccacaagtgaggaccggtcacagccgcgcagtggagactcaggcagtgtcagatcactcttcagacctgttcggagattggccaaagcgggaggtttcccaggaccggaaggcgggaccctggggacatgtgggcgaaccctgtctggtcgggaccttgcccggaaactgaaaccggcgaaatatggggcggggcaatgcgcacaatacgaattcggcaccagcgaggacaatctgtacacacagtgttgtaacacatccgtcgcagatatgtaggagagaaggtagaaatcgc

SEQ ID NO: 316323 - DNA, 2228 bp, Homo sapiens
acgaggctgggtggtggtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316324 - DNA, 2286 bp, Homo sapiens
  misc_feature (22)..(22): n is a, c, g, or t
  misc_feature (157)..(157): n is a, c, g, or t
tatgctccgtcggacggctttntattgtcgacgtgccgggataagagcagcgtcagtgatagactggcaacagtaggctactagtacgtcgtgtgatcgcgtggacaccaggcttgacttgtgtagcaacaccctaggtagaactcgttgcgcaggncacatccgcgtactagactggagctcagtagttgagatgtgcagcagtagatgccacggttatgcctgctgtatctgcatatcggctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316325 - DNA, 858 bp, Homo sapiens
gggaagggatactccgacaggagatactcggtgtagagacaaggttctcctcagtgaactggcagtaccagtgggggcttacctgtgagcaacaaggccgaccattctccctatcagggcatccgtccaggttattcaaagttccggcacagttatccccaccccctgacaagagttccagagtcaatgtattacagaggtatgacgtgcaacagagaatgaggtgttgttggccgcagcttctaaatccactggaactcagtattactcaaaggggatgctgaaattctcacgtgtgttgctaagggcttactgttgctgttgttcctcaacacattggccttgttcctcagcaaacccctggagccagaatattgcaaagcgctatatgttatgagcaaaccaccctggcgtttagtaatttgttcttgagaatggagtttgtgctcttgttgcccaggctgaagtgagtttcgggtcaccacaacctcctcctcttgggtgcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316326 - DNA, 540 bp, Homo sapiens
ttaggctggtctcgaactcctgaactcaggtgatccacccacctcaacctcccaaagtgctgggattacaggtgtgagccaccatgcccagcctacaagcactttttaagcctttgctggttccatctgctcatgtcccattggccaaagccagccacgtgtccaggctcccttgcaagcgcaggagaaattgacacaatgggaagagctacaggggatgtgcagcccttctttgcaccaaccacacagagcctgagtatgtcaatgattaaaccaaaggccccagagctcaccgtagccaggaaacccttcctccctccctccctttctcttttctagactgtcatgtaagtcagatgctggaaggattccttgggttccttctggaatcccgtctctcccaggggagcctccttccctcacttctctctcccctgccccagatggaaactgtcaagcaaggcgttgatcagaagctggtggaaggccaggagaagctgcaccagatgtggctcagctggaaccagaagcagctccagg

SEQ ID NO: 316327 - DNA, 963 bp, Homo sapiens
acgaggctgggtggtggtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggccgaatcggcgcatccctggattggttcgacgtcgagtcagtgcacagaggagcgaggaacaagactactcgacgtttggccccgcgggaaggtgcggaacgcataagatctgggcgtttaccaccagcgaggcaggagttgtgccgtcagcctactgaggaatcaaagctataagctggagcggaacccatgtgcgacaaactcgccagagccgaggcggccatgaacaaggttcggaagctgaggacggaggtaca

SEQ ID NO: 316328 - DNA, 2555 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggccatgtgtgtacgtgtgtgtgtcttcatctgtccctgctgctagaacagaaatatcttaggcagggtaatttatttattcatttatttattttgtagagacggggtcttgctatgttgcccaggctgatcttgaactcctgagctcaagcgttcctctcaccacgtcctcccaaagtgctgggattataggcgtgaaccaccacgcccagccgaaagtatttattgtctggtcctttacaacaaacagtttgctgaac

SEQ ID NO: 316329 - DNA, 2023 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatatctttcaggaaagttctcccctggcagaattttttttccttgttaaatatcaggaatataggccgggcatggtggctcatgcctgtaatcccagcactttgggaggctgaggcaggcagatcacttgaggccaggagttcgagacc

SEQ ID NO: 316330 - DNA, 1773 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgcatacaggccatgtgtgtacgtgtgtgtgtcttcatctgtccctgctgctagaacagaaatatcttaggcagggtaatttatttattcatttatttattttgtagagacggggtcttgctatgttgcccaggctgatcttgaactcctgagctcaagcgttcctctcaccacgtcctcccaaagtgctgggattataggcgtgaaccaccacgcccagccgaaagtatttattgtctggtcctttacaacaaacagtttgctgaac

SEQ ID NO: 316331 - DNA, 2165 bp, Homo sapiens
actccagtgcgcccccaacctaccacgcagtaaaagccacccccgccccggcccggacggtttccaagctggttttgaagtcgcggccgctgttcctgggacgtccggttgaccgcgcgtctgctgcagagaccatgtctgccgacggggcagaggctgatggcagcacccaggtgacagtggaagaaccggtacagcagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316332 - DNA, 2169 bp, Homo sapiens
gtgtaggacaccctgagtttccggctgagctccccatcttcccccacccagtttgcctgagccacttctctcctgtagcccagtgtggtggaccgtgtggccagcatgcctctgatcagctccacctgcgacatggtgtccgcagcctatgcctccaccaaggagagctacccgcacatcaagactgtctgcgacgcagcagagaagggagtgaggaccctcacggcggctgctgtcagcggggctcagccgatcctctccaagctggagccccagattgcatcagccagcgaatacgcccacagggggctggacaagttggaggagaacctccccatcctgcagcagcccacggagaaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcagtcatgggctcccgcttgggccagatggtgctgagtggggtcgacacggtgctggggaagtcggaggagtgggcggacaaccacctgccccttacggatgccgaactggcccgcatcgccacatccctggatggcttcgacgtcgcgtccgtgcagcagcagcggcaggaacagagctacttcgtacgtctgggctccctgtcggagaggctgcggcagcacgcctatgagcactcgctgggcaagcttcgagccaccaagcagagggcacaggaggctctgctgcagctgtcgcaggccctaagcctgatggaaactgtcaagcaaggcgttgatcagaagctggtggaaggccaggagaagctgcaccagatgtggctcagctggaaccagaagcagctccagggccccgagaaggagccgcccaagccagagcaggtcgagtcccgggcgctcaccatgttccgggacattgcccagcaactgcaggccacctgtacctccctggggtccagcattcagggcctccccaccaatgtgaaggaccaggtgcagcaggcccgccgccaggtggaggacctccaggccacgttttccagcatccactccttccaggacctgtccagcagcattctggcccagagccgtgagcgtgtcgccagcgcccgcgaggccctggaccacatggtggaatatgtggcccagaacacacctgtcacgtggctcgtgggaccctttgcccctggaatcactgagaaagccccggaggagaagaagtagggggagaggagaggactcagcgggccccgtctctataatgcagctgtgctctggagtcctcaacccggggctcatttcaaacttattttctagccactcctcccagctcttctgtgctgtccacttgggaagctaaggctctcaaaacgggcatcacccagttgacccatctctcagcctctctgagcttggaagaagcctgttctgagcctcaccctatcagtcagtagagagagatgtccagaaaaaatatctttcaggaaagttctcccctgcagaattttttttccttgttaaatatcaggaatataggccgggtgcggtggctcacacctgtaatcccagcactttgggaggctgaggcgggcggaacacctgaggtcaggtgttcgagaccagccaggccaacatggtgaaaccccgtctctactaaaaatacaaaaaaaaatgagccgggcatggtagcaggtgtctgttatcccagttaggaggctgaggcaagagaatctcttgaacctgagaggcggaggttgcagtgagccaagatcgcgccattgcactccagcctgggggacaagagtgagacttagtctcaaaaaaaaaaaaaaaagaaaaaaaaatcagggatatagttcatatcccacttctttgtttacaccgatgtccctgaatatcagcctgtagctaatggacttgggatttctggtctaagtgggcctcctggggatggggtggtacactgagcttctgagcctcattgtagagtagaaaggtactggggcctgtgtggtaagccttgttgaaatgctctggtattcagtattgccttaataaacttcacccacaactgca

SEQ ID NO: 316333 - DNA, 2018 bp, Homo sapiens
atgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaaggcagggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggctcttttcagagccaaccaccttttctataaaagttgctgtttactgttgctgtccgtaaactggaacctctgttcactcaagggacgaggtctcactgtgttacccaggctggcctcaaaactccttagcttggccaggcgaggtggctcaggcctgtaatcacagcactttaggatgccaaggcgggcggatcacgtgatgccaagagttcgagaccagcctgcccaacacattgaaacttcgtctctactgagaatacaaaaattagccgggtgtggtggcacacgcctgcagtcccagctacatggaaagctgaggcaggagaagggcttgaacccgggaggcggaagttgcagtgaaccgagatcacaccactgcactccagcctgggcagcagagctagactccttcaaaaaaaaaaaaaaaatccccaaggacaaacaaaaccaccaaaaacaactccttagcttaagagattctcccgccttggcctcacaaaatgctgagattacaaacgtaggccaccgcgaccggcaagggccgatcttcatatcgtagccgccaacacctacttgagcgcggccacagagaaggccgctgcgcttcttggagacggctaagtcattagtgatgaactcacataccggaggggcctggacatcttgcacttcactgcaacttcggacttgcaacctttttctttacttcagtctttgacttgggagatagaccaggagtcacggcatgtacagtttcggacatgattgtaggtttggatatctaacagttaaaaaaaaaaaaagtcaggctgcgagtgtgtctgtgattacgtgtgtgtcacacacagacacgctgcgcgctgattggttcccagctcagtctttcagcttggcagcaacctagtctcaaccctgtttctgagttgtgtttgcggaaattcagaaaatcaaaatagtttaaatttcctgaggaggaatcacaccaattctattctacaatgaactggaacggctacggtgttatgatctttacattttctttctctagtttttacttaaggcagcctcggcctttatcaaaagttccaactttcagagattcacagttcagagggacaacttcttgattttcatttaaaatataaattcttccattcgtgtcttc

SEQ ID NO: 316334 - DNA, 5973 bp, Homo sapiens
cacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgcggcggggctgtcctcgcggactgactggactccatctcccagcgggcgccgcggcgcggccacgcccccccactccccgcgcgcgcccggtggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316335 - DNA, 5850 bp, Homo sapiens
agtgcagacgcggaactggcgcccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316336 - DNA, 5957 bp, Homo sapiens
agtgcagacgcggaactggcgcccgctcggagcggcgccgcgctggggagcgactgacgccccgctgccgggggacgtcgggctgggcctggccagtcccccagagcttgggagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaagtatttgggctaaatactctaatggagattgttactgaagccggccccgggagtggtgaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaattgtggaacaagcaccaggaagtgaaaaagcaaaaagctttggaaaaacagaggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316337 - DNA, 487 bp, Homo sapiens
ggagagacagcctgggtatgggcaagaaatgactgtaaatatttcagccccacattatttatagaaaatgtacagttgtgtgaatgtgaaataaatgtcctcacctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316338 - DNA, 5710 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316339 - DNA, 5744 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactcccaaaaaaaaaaggtaaaaaatggaggaaatttaaa

SEQ ID NO: 316340 - DNA, 6095 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcggtgagagcctgggcatcccttctagatgggtgactgaaggacctcacctcagtggaccctgggcaagggttaatcagaaagtctgagaagtctgaatgctctcgtggtcctgccatccccagaggatggtgttctgatccaggggcttaggaattacgggaagggagtggcaactgtagtatagcataattatggcccatactcccaagatcaggtacccctgcctggggatcataggtgcctctgtgcattcaagggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316341 - DNA, 4289 bp, Homo sapiens
tataaaggttactcttctggtctctgtcttcaagttccctttgattgattcatgtaatctttgatgtacttcttgtaggcttcttttgtgaacttgttcctgcaggtgatggttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316342 - DNA, 2720 bp, Homo sapiens
  misc_feature (49)..(52): n is a, c, g, or t
  misc_feature (57)..(57): n is a, c, g, or t
  misc_feature (67)..(67): n is a, c, g, or t
  misc_feature (79)..(79): n is a, c, g, or t
  misc_feature (82)..(83): n is a, c, g, or t
agctcggtaccctctgcgacacctcattgatttgctggctgtacacaannnnaatgngcgactttcncattaggcgccncannttcttgcggatgtcattcttatttaccttcatcagcagcatgtaggagatgaggttgtgcagaagtgtggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggaagggacaaaggatccatgtgggaccagttagaggatgcagctatggagaccttttctataagcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316343 - DNA, 1572 bp, Homo sapiens
ccacgagggtccgacatgtagcttaaatgtctgcgttgtatctgtccctgcatggacagatacaaaagatatctccgttgtatctgtccctgcatgtaccacaaatgtctgcttcttcatgtaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttgttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316344 - DNA, 1174 bp, Homo sapiens
ccccgactagcccgacagcaaagcatcaaacccggacctgaattgggtggcgagttccctgtgcaggacctgaagactggtgagggtggcctgctgcaggtgaccctggaagggatcaacctcaaattcatgcacaatcagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316345 - DNA, 1550 bp, Homo sapiens
cttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctgggaattccccactgcagctcctcaggggccctggacagtagctgtgaccaggctggtgaaaggcccgtccctcccatccagggctttcaaagaagtgggtagaatcacggccatcaagtaaacgccactgcggatgacagaggcctagctgaggaggctagggccatgtcctcccagctggcagagtctggacagagcctctggtggcctctgccctgtcatagcctaagctgctgcagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316346 - DNA, 5391 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagagggggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccagcttcagtctttcaaacctcacactgcccaccaaaggtgcccgagagaaggccacgcccttccccagtctgaaaggaaacaggagggcgttagtggatcagaagtcatctgtcattaaacacagcccaacagtgaaaagagaacctccatcaccccagggtcgatccagcaattctagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattgggcctgaagtaatcaaacctgtctttgaccttggtgagacagaggagaaaaagtcccagatcagcgcagacagtggtgtgagcctgacgtctagttcccagaggactgatcaagactctgtcatcggcgtgagtccagctgttatgatccgcagctcaagtcaggattctgaagttagcaccgtggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaagtgtcgggagctgtactactgtgtgaaggacagcatggagcgcgctgccgcccgacagcaaagcatcaaacccggacctgaattgggtggcgagttccctgtgcaggacctgaagactggtgagggtggcctgctgcaggtgaccctggaagggatcaacctcaaattcatgcacaatcaggttttcatagagctgaatcacattaaaaagtgcaatacagttcgaggcgtctttgtcctggaggaatttggtaattacactattttgctcttaggtctggactcacatggcagtaactcaaacctcggagctccagaggagggtctaggggcagggagaagaagaacctctgtagagaagtcaggaggagcaggagtgacaaggaagaaaagggacccctgagatgagagccgggatgtggaagggaaagatagataatggatcgcagaagagcaatggggcctcaggtgggtttcgagtttagaggtggtcctgaagcagctcagtgaagtagcaccacctccccgtgctgggccagccagtggtcagaaagtttgggacacagcagactggcgacccccaagctccactatgtccatgtcacctgctgcaatctctctagcagcccagtgcgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctgccttgggccctgccctgggtgggtagctcccatcga

SEQ ID NO: 316347 - DNA, 3098 bp, Homo sapiens
accgcggccgcgcgcccccctctgcccccgctgcccaggattggtaggctccaccgctcggcagccggcttccctgctcggacgccgagcaccgccaaagcgcacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaatgatgtggattctgtggatgttgcaaccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacaatatgtttgatccagccctgattggtgacaagccaaagtggtatgctcatcagctgcagcctatccactatcgcgtctatgacagcaattcccagctggctgaggccctgagtgtaccaccagagcgggactctgactccgaacctactgatgatagtggcagtgatagtatggattatgacgattcaagctcttcttactcctcccttggtgactttgtcagtgaaatgatgaaatgtgacattaatggtgatactcccaatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgaacctgctgactctacggagatggatgataaggcagcagtaggcgtctccaagcccctcccttccgtgcctcccagcattggcaaatcgaacgtggacagacgtcaggcagaaattggagaggggtcagtgcgccggcgaatctatgacaatccatacttcgagccccaatatggctttccccctgaggaagatgaggatgagcagggggaaagttacactccccgattcagccaacatgtcagtggcaatcgggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagcagcctctatcggaaccacagtaccatgttggctgctgcctgccacagcctctgtgactgcagtggagcggcgaattccctgtggcctgccacgccttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccacattatttatagaaaatgtacagttgtgtgaatgtgaaataaatgtcctcaactccc

SEQ ID NO: 316348 - DNA, 215 bp, Homo sapiens
gtgagtctacctgccctctgctccgctctgccttgtgcctctgtcctcctgatggactttgatttttcctttgctaatgtttgacctgtgccttctatcctggctctgctttagactttttcctgcctttctttcaggcgttgcttgcctttttttccttgctgctgactttctgttcttttccctcatggggtagatatgtttgatccagccct

SEQ ID NO: 316349 - DNA, 300 bp, Homo sapiens
agaggccagttttaagggtggtcttttcttagagccttggttgtctcctggtcacttggcttccagctctgaggtgcccaagaaccaaggttatgtgcattcctcaagctttgggagaatgctcagattatctggcttactgctcctcggaggggtagaggggttgcggtattgtggtacacctactaattgtgtattttgtgtcccagtatttgggctaaatactctaatggagattgttactgaagccggccccgggagtggtgaaggtgggtcttgcctgtgagctgtgcatgatct

SEQ ID NO: 316350 - DNA, 407 bp, Homo sapiens
cgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaaggtacagtttgctgctgatgcctaatgggggaagcatttagagattccatgtaattggtctttgaggggcataggaaatttcctctacagctcaagg

SEQ ID NO: 316351 - DNA, 559 bp, Homo sapiens
caggcagcacccatattttccaaggtgttacagtcaggttactttatccaaaatagcatcttgagctttatttgttgactgtggttaaaatttgatagcccattccatcccttcaggctgctgaatttgtctttatgttcttcaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcgggg

SEQ ID NO: 316352 - DNA, 562 bp, Homo sapiens
agtgaggcgtggggagtggttggaggtgaggatgagtcaacaggttggggcccaaaggcacagcgatcctgttctcagattgtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggtgctcccccaggctcacatcgtgcgcgcccccaggccgtcacgagccccctaggtctgggtcctaggagccccggctacttgcatgcaccatgccctccatctaccagacacaggacattttcaggcgctgttccctcctagatcaaaccaggcctacctgttcatctctattttgtacaattttaggttgaatta

SEQ ID NO: 316353 - DNA, 4237 bp, Homo sapiens
  misc_feature (1)..(1): n is a, c, g, or t
  misc_feature (20)..(20): n is a, c, g, or t
  misc_feature (54)..(54): n is a, c, g, or t
  misc_feature (99)..(99): n is a, c, g, or t
nagagcgacgcggtggcggnggcagcgccagccccctcctcccccgggaagtcngccgggcttgaggccgggccccagacgtcccgcttcgccccgagncgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacagcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagcccctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggctgcgcat

SEQ ID NO: 316354 - DNA, 4286 bp, Homo sapiens
gccttcctgagtgagcggtggagggaaccctagaggacagagcccccagcccggcagcaggccccctctccgcccgccaccacggaggagaaggaggacagccagcccctccagccctggcctggcccagcgggggcagtaagctcctacttgcccccagcttggtgcccacacgggcccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacagcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagcccctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggctgcgcat

SEQ ID NO: 316355 - DNA, 4186 bp, Homo sapiens
agtgaggcgtggggagtggttggaggtgaggatgagtcaacaggttggggcccaaaggcacagcgatcctgttctcagattgtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacagcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagcccctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggctgcgcat

SEQ ID NO: 316356 - DNA, 3291 bp, Homo sapiens
  misc_feature (1)..(1): n is a, c, g, or t
  misc_feature (20)..(20): n is a, c, g, or t
  misc_feature (54)..(54): n is a, c, g, or t
  misc_feature (99)..(99): n is a, c, g, or t
nagagcgacgcggtggcggnggcagcgccagccccctcctcccccgggaagtcngccgggcttgaggccgggccccagacgtcccgcttcgccccgagncgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagcccctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaacctggctgcgcat

SEQ ID NO: 316357 - DNA, 411 bp, Homo sapiens
taattcgttgtcatctgactttttaaaaggagttaaacttagaatgcaattcctccgtgtcacagcagctgaagttgtgctgttggtatcctaaaattctagagagtgttggtatcatcatgtagaattccaaatcctgcagggctaattcatccgccaccatctagtctaggttgcaaaagctagaaatccagtgcaaagtggtggcttaagaaaaataaagaatttatcagttcatattacagatccagggcttagagtgatgtcagcagaactgcctcctctttgactgcatttgcaagcaggctgtctccctgggctggaaaaaatggtgcctcaggctcctatccactctacttcttaacagccctagagggaagagatctcctctttcctgaaagctccaagaaa

SEQ ID NO: 316358 - DNA, 969 bp, Homo sapiens
cgagacgctggcgaaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaaacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgaagctggatgacttcgctgaaaagtcccgtaagggtcctgaatcctgtacggctgatatacgaagtgaacactcaaactcggggagtaac

SEQ ID NO: 316359 - DNA, 1555 bp, Homo sapiens
cactcccgcggggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaatttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316360 - DNA, 2425 bp, Homo sapiens
cactcccgcggggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggtgagtagccagttgctgtgtgggagcggggatccaggtctcacccccaccccgccctcttccccatcctctgcctccaggcccactgcagccccatcggtctctaccatgttctgctgcccaggaagaggcacctgggggccagacctcttcttcctccacaggaaacccagcgtccctatgaagaggctctcctacagaagatgtgggaaagccaggacttcctgaaatgcatgcaaaggttcagagaagtgcgtgggcaaggaaggtggtggtccctgtagggaagcagtggatgggcagtccccacggcctgtgggaatgagtcaggcttctcctgatctggcgctcaggaggtctctgattctggtgttggcctccctccttgccggtgccattactgtcacttgtctttcatctgggaaggcgattggcactgacctaggccttgcctcattagccagcaatgctggctaatgacccatttacaaccatcaccaaacatcacctattcagccattaaccaccgtgcatctttaccccttgattcttgttactgcccaccacccattatcagtgttaatgaacttcaccatcactgccttcttgaattaattttcattatcttgcctcttcactggtttttaatgtgcatgcccttcactatctctgccagcctccattcattcccatgattgagcattccccgccactttgtaacctgtctccattctccatgatccctcacctgtttcagcaccactgaatattgtcactaacttggaagccagccgcaccttgcatggggaagtcccctctctggagtccagcaagtcccagtgacagaacccataccatttccccagatagctttgctcctcgttcattttggcctttctccctttggttgggggccatttgcctctcccttctcccctgctgtgcctttcctctcagtttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316361 - DNA, 2261 bp, Homo sapiens
cactcccgcggggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaagtgcgtgggcaaggaaggtggtggtccctgtagggaagcagtggatgggcagtccccacggcctgtgggaatgagtcaggcttctcctgatctggcgctcaggaggtctctgattctggtgttggcctccctccttgccggtgccattactgtcacttgtctttcatctgggaaggcgattggcactgacctaggccttgcctcattagccagcaatgctggctaatgacccatttacaaccatcaccaaacatcacctattcagccattaaccaccgtgcatctttaccccttgattcttgttactgcccaccacccattatcagtgttaatgaacttcaccatcactgccttcttgaattaattttcattatcttgcctcttcactggtttttaatgtgcatgcccttcactatctctgccagcctccattcattcccatgattgagcattccccgccactttgtaacctgtctccattctccatgatccctcacctgtttcagcaccactgaatattgtcactaacttggaagccagccgcaccttgcatggggaagtcccctctctggagtccagcaagtcccagtgacagaacccataccatttccccagatagctttgctcctcgttcattttggcctttctccctttggttgggggccatttgcctctcccttctcccctgctgtgcctttcctctcagtttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316362 - DNA, 1595 bp, Homo sapiens
cgagacgctggcgaaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaaacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaatttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316363 - DNA, 1408 bp, Homo sapiens
  misc_feature (6)..(6): n is a, c, g, or t
ggcagnaggcggagaccactgttcaaggccacaggattatgttccatggcagcagtccaagcaggaaaccaagccatctactctgcctccagtccaacaagccaacagccttcatacaagcaaaatgaagactttgactagggtccaaccagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaatttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316364 - DNA, 1771 bp, Homo sapiens
cgagacgctggcgaaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaaacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccaggcagaaccacagcccttagagtgtttcagagacagccagttggagttttgcgtggctgctgtgccttcgtctggtgttgtggtcccacttctcaggtcactagaagtaagagtaacaactggtaatgtgtatccagcactgaatatgcatcaggcactattccaaacacctttaagtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaatttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316365 - DNA, 1437 bp, Homo sapiens
cactcccgcggggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccgtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaatttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316366 - DNA, 2143 bp, Homo sapiens
cactcccgcggggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccgtgtttcacttcaagcccactacggtggtgacaagctgccagccgaagaatccaagagaactacatagaaggcggaagttggaccctgggaagatgcatgccaaaatctggttaatgaagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaagtgcgtgggcaaggaaggtggtggtccctgtagggaagcagtggatgggcagtccccacggcctgtgggaatgagtcaggcttctcctgatctggcgctcaggaggtctctgattctggtgttggcctccctccttgccggtgccattactgtcacttgtctttcatctgggaaggcgattggcactgacctaggccttgcctcattagccagcaatgctggctaatgacccatttacaaccatcaccaaacatcacctattcagccattaaccaccgtgcatctttaccccttgattcttgttactgcccaccacccattatcagtgttaatgaacttcaccatcactgccttcttgaattaattttcattatcttgcctcttcactggtttttaatgtgcatgcccttcactatctctgccagcctccattcattcccatgattgagcattccccgccactttgtaacctgtctccattctccatgatccctcacctgtttcagcaccactgaatattgtcactaacttggaagccagccgcaccttgcatggggaagtcccctctctggagtccagcaagtcccagtgacagaacccataccatttccccagatagctttgctcctcgttcattttggcctttctccctttggttgggggccatttgcctctcccttctcccctgctgtgcctttcctctcagtttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316367 - DNA, 1329 bp, Homo sapiens
aacggatgagagtcccggagctcccgggcggcgcagacaatggggaaccgcccagcttgggccgcgtttaccagcaggaggccgcacgggggcgggcgtctggcggggccggggcggcgggtccacgggctttcgggggctcaggccgggcagggcgcagcgccgcctctctgctcttccctccgcccgcagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggaaacccagcgtccctatgaagaggctctcctacagaagatgtgggaaagccaggacttcctgaaatgcatgcaaaggttcagagaatttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316368 - DNA, 2199 bp, Homo sapiens
aacggatgagagtcccggagctcccgggcggcgcagacaatggggaaccgcccagcttgggccgcgtttaccagcaggaggccgcacgggggcgggcgtctggcggggccggggcggcgggtccacgggctttcgggggctcaggccgggcagggcgcagcgccgcctctctgctcttccctccgcccgcagacgtcgctcaggagcgggagggccgctctgcgagagctccgaagccgtgagaacttcctcagcaagctcaaccgggagctgatcgagaccatccaggagatggagaacagcacgaccctgcacgtgcgggccctgctgcagcagcaggacaccctggcgaccatcatcgacatcttggagtactcaaacaagaagaggctgcagcaattgaaatctgagcttcaggagtgggaagaaaagaagaaatgcaagatgagctatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggatgagctggatgacctcggtgagatgcgcagaaaggtcctggaatccttgtccgacaagattcagaagaagaagaaaaaaattctgagttctgtggtggcggtgagtagccagttgctgtgtgggagcggggatccaggtctcacccccaccccgccctcttccccatcctctgcctccaggcccactgcagccccatcggtctctaccatgttctgctgcccaggaagaggcacctgggggccagacctcttcttcctccacaggaaacccagcgtccctatgaagaggctctcctacagaagatgtgggaaagccaggacttcctgaaatgcatgcaaaggttcagagaagtgcgtgggcaaggaaggtggtggtccctgtagggaagcagtggatgggcagtccccacggcctgtgggaatgagtcaggcttctcctgatctggcgctcaggaggtctctgattctggtgttggcctccctccttgccggtgccattactgtcacttgtctttcatctgggaaggcgattggcactgacctaggccttgcctcattagccagcaatgctggctaatgacccatttacaaccatcaccaaacatcacctattcagccattaaccaccgtgcatctttaccccttgattcttgttactgcccaccacccattatcagtgttaatgaacttcaccatcactgccttcttgaattaattttcattatcttgcctcttcactggtttttaatgtgcatgcccttcactatctctgccagcctccattcattcccatgattgagcattccccgccactttgtaacctgtctccattctccatgatccctcacctgtttcagcaccactgaatattgtcactaacttggaagccagccgcaccttgcatggggaagtcccctctctggagtccagcaagtcccagtgacagaacccataccatttccccagatagctttgctcctcgttcattttggcctttctccctttggttgggggccatttgcctctcccttctcccctgctgtgcctttcctctcagtttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316369 - DNA, 1264 bp, Homo sapiens
ggtctgatgatgaatttgtgaactctatctttggtatatcttttattaaactgcactgttttgtttagtggatgggcagtccccacggcctgtgggaatgagtcaggcttctcctgatctggcgctcaggaggtctctgattctggtgttggcctccctccttgccggtgccattactgtcacttgtctttcatctgggaaggcgattggcactgacctaggccttgcctcattagccagcaatgctggctaatgacccatttacaaccatcaccaaacatcacctattcagccattaaccaccgtgcatctttaccccttgattcttgttactgcccaccacccattatcagtgttaatgaacttcaccatcactgccttcttgaattaattttcattatcttgcctcttcactggtttttaatgtgcatgcccttcactatctctgccagcctccattcattcccatgattgagcattccccgccactttgtaacctgtctccattctccatgatccctcacctgtttcagcaccactgaatattgtcactaacttggaagccagccgcaccttgcatggggaagtcccctctctggagtccagcaagtcccagtgacagaacccataccatttccccagatagctttgctcctcgttcattttggcctttctccctttggttgggggccatttgcctctcccttctcccctgctgtgcctttcctctcagtttattgaccagtttgaggagaacatgcctgtattaagggccgaggtggaagagctccaagcccagacccgggaaccccgagaggtcatatttgaggatgttctgcttcggagacccaagtgcaccccagacatggatgtcatcctcaacattcctgtggaagagccactacccttctagatggcagtgccatgggccgccctcccctcctgctctcttcccagcacctggagccttggatcatttacttccaggaccggatctccattcagaccctgatctacagtctccctgctccctctgcccttcctccctctttctttccctccctccctccctcccttcttccccccttcccttccctcctccttccttcctcctctccctccctccctcctttctttcttcctgtggttttttcctctcttcttcccttctttctggttggtgctgctgggccaggtgggaatttctgattaaatctgctattccttttttaccaataaagctggatttacatttgcttttttg

SEQ ID NO: 316370 - DNA, 430 bp, Homo sapiens
cactcccgcggggctattgtccccggtaaactgcagtttctggttcgagactccaatcctgtttcgaattgctgcttgctgccccttgggctggggataatggaagttctttcccttcccaactctttccagacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccaggtgggcggaggcacctgggagctggtgtgggggttggagacaggatagagtggctgcttttggctcttggtgacaccacttatattagggtaggctaactgatgtaataaacaatgcccaaattgcaagta

SEQ ID NO: 316371 - DNA, 992 bp, Homo sapiens
cgagacgctggcgaaagcatcgggtctcgggacttctgagtggcctgggttaccgcgcgatctacactgagacaaggaagttggaaaagccgagtagttataccagaagatcagggtctcacagactcgcaacttctcttccattttccccaatggcgcatgtcttacaaaaacccaagcactctgggactcactccatagtccaggagttccaggttccggattatgttccatggcagcagtccaagcaggaaaccaagccatctactctgcctccagtccaacaagccaacagccttcatacaagcaaaatgaagactttgactagggtccaaccaggtgggcggaggcacctgggagctggtgtgggggttggagacaggatagagtggctgcttttggctcttggtgacaccacttatattagggtaggctaactgatgtaataaacaatgcccaaattgcaagtattgatatagaagtttatatctcatttatgccacagtacatttgtggatctgaggaaggagggattctgttccacatggtcattcagggatccaggttcctttgaccttgtgggtctgatattttgtaaggtcttgaagtcttctgctggatacttttgcatccagctggcatagagggaagagagagaacaagaacatggacaattatgtgggcattttttttggggggggtccagatttgaagtgacaaatgttactcctactcatgtttcaggggccataatttagccacatgacctctgctaaccacaagggaaggtgggaaatgtagtccatctgtttttccaggaggaaaagaaaacaaggtttggtgaaatcgtagaataaactctgccacatcattatcatgctttacaggggagttccgaggccttgggtcaggctcaggcagacatggggtcagattttggctctgccatttactcacttggaaaaatcattcatctctctgagccttggttt

SEQ ID NO: 316372 - DNA, 439 bp, Homo sapiens
tgcttgagggaaggtcttgcctcctgtccctgctgacctccctaacccctccccagatcttgagcagcaggcagagcagctgaatgccaagattgagaagacccaggaggaagtgaacttcctgagcacttacatggaccatgagtattccatcaagtctgtccagatctccactcttatgcgccagctgcagcaggttaaggacagccagcaggtaggggagcccctgcccctctcccaccagactgtgtgggaggcaggactggtgaccaacacccttctgctggctcccaggatgagctggatgacctcggtgagatgcgcagaaaggtcctggaatccttgtccgacaagattcagaagaagaagaaaaaaattctgagttctgtggtggcggtgagtagccagttgctgtgtgggagcggggatccaggtctca

SEQ ID NO: 316373 - DNA, 626 bp, Homo sapiens
cgattagcctctggtcaggtttctgggagtgaggttgggactggggactcctctgaggaagtgctgggtggccgcctctgagagccagcagagcctgtgggtgagttgactccacccctcccgcagaccatcatcgacatcttggagtactcaaacaagaagaggctgcagcaattgaaatctgagcttcaggagtgggaagaaaagaagaaatgcaagatgagctgtaagaatccctggcaaattccttgaccctcccccctggcaccttggggaggtcagcagcagagcattcaccttgtacttgccattcagaaaccctcagccccattggctctcttcttggcagatgggaatgctaagatacagagcgaatagcatagttacccaacacttagctctttccaggccccgtatctgggtctctaccaatgtctgcattgttacaggcacacactcagtcattgcaactacttggaggcagggaagctgtcctcccattttacagatgaggaaaccgaggctaagagaggtgcagtagcttgtggaaggttatatagctaggagccagaatccaatcctagcctggctctgtttcctgccaaggtccttctgggagtcagtgg

SEQ ID NO: 316374 - DNA, 832 bp, Homo sapiens
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaagaattaagcaccataaaaggaggaaacgtctgacttgttctatgcccaacacatagagtagtgcctgatacatagtggaccctcaaaatttgttgaatgaatcagtgaactagagcagtgattcctaaagggtccctccagaccagcagcatcagccttacttgggaacttgttccaaatgcaaattttccccaccccagatctacttcatcagaaactctgggggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtgggggttattggggggtgtgccatcggcaaaggcagggcaagctgcaaagacgggaatagagaaagttcgatgaaagaatgaccgccggatattgttaagaagttggccatatt

SEQ ID NO: 316375 - DNA, 5637 bp, Homo sapiens
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316376 - DNA, 5889 bp, Homo sapiens
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgtaaaatgcacttttctgtcttttctttgcaaagcagaagtatctcaatgtaaaataaaaatggagctcagtgggcagtattaataaaggccatgttttaaacataggctttatacttttagttttcatttaagtgattgcttttttcctaagtgcttgtaacttacagttggaaaatcagatttcacaaaaccaagcattttagtatattcagcctttacaataaaatatttctactaattataaaaatgaaaa

SEQ ID NO: 316377 - DNA, 5430 bp, Homo sapiens
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316378 - DNA, 5475 bp, Homo sapiens
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316379 - DNA, 4736 bp, Homo sapiens
aggtttgccagatgctttgaaatgggctgtctttcttttcctttcatgtaatgtctgatttttatgtggaagagaatgtaagtagtgctgtataaccctgcggatgctatgccctaagagggaaagcaaatatttgcaagtcagactgaaaaatgtccagaccctgtactgattaagtagaaggggaatctaaccactttgcatttgaaagaaaatgcagcatatagcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316380 - DNA, 3932 bp, Homo sapiens
ttagtaagtaggccacagaaatcttctccttctcctccttcttctcctcctccactgatatgttattaaggtaatacttaggttgtgaataatctacctgttggattcttttagcatattttattctccattaagttattagtagcattatcagtattataacttactgcagggaagaaactgaaagcaaatgtgactctgaaggagaggaagatgaggaagacatggaaccctgcctaacaggaaccaaagtgaaagtaaaatatggacgagggaagactcagaaaatttatgaagccagtattaaaagcactgaaattgatgacggagaagttttatatttggtacattactatggatggaatgtcaggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316381 - DNA, 2064 bp, Homo sapiens
tcaggttgaccttgtttctgattgagccaagttccttcatgggatctcccaactagaggtttaagagtttttgtctctttaatctttacattttatgatgtatttttaagtgttgagtagtgcttaactgaccaaagactaactccacttaattgagccaaacaaaatttttgctgacaatttgttactccttcatgtgacatataagaggcctgtgattaaggtgaataatgttaagaattttatttctaatttgctgttagctgggtatctttgtgtaacagtttttggatctaacatagttgttttgattccacagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316382 - DNA, 2025 bp, Homo sapiens
caacattctctctttccccttatttcaggtcagaagaggccaagtgatggaaatagtggattaatggcaaaaaagcaaaagcgtaccccaaagcgaacaagtgctgcagccaaaaatgaaaagaatggaacagatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316383 - DNA, 1805 bp, Homo sapiens
tcgacatgacacgatgagatactgattaacccagaagcatgggtgcacgctgcatgacgggggccttccgtagtcatctgcttcatcaactagagacatggattgtttcgcatcaggtaccgcgactcgaatgtcagctagtcgtggtacatgtcgtgtgatccggagttgtctctagcacttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316384 - DNA, 1470 bp, Homo sapiens
aggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316385 - DNA, 468 bp, Homo sapiens
tgtgattgaaagttatttcagcgcatctaatctgctttactccatttcttatgttgtcctgatttcctttccaaaatcaggatgcaggtagtgtctgcgattatgatacatattacagagctacatcttttggggtgaacagccttcatatcaaaacttatgatagttatgtttagctatcacaagctcagacgtctcaggacggcattttatgatcagtttttctgtttatgattctatctaaaacaccaagaaaatagtaacacagaaaagagtaacaaaaatttttttaaattactgggctttactttttaaaaatgtgtttaataacatgaattcaagttagatgcaaagactgtaagatttcttaaatgaaatattgtttgtttaggtatctctatggttttgaggagtactgccgttcggcaaatattcagttcagaactgttcatcaccatgaaccaaaag

SEQ ID NO: 316386 - DNA, 748 bp, Homo sapiens
atttatgaagccagtattaaaagcactgaaattgatgacggagaagttttatatttggtacattactatggatggaatgtcaggtaagcaagaaactattttcttactattgaaattttttcgatgattaaatagaacatcaacttaatgttatgaagagtgaaagcaaataatggtacatatttacaaagcacaccttggttctgaattttccaagactttgacattcctgctgttatactagcagtgtcaatgcttctagccagagactaccaggatcacacctgtagttagaacaagttacatttattactcatttatagtgagggagaacacacagcaaggggaaccatagggcatcttagtaatatggtgttaaatgaatcaacagaggctcaaggcaccatctttgggaaaacaataattcataattctgtggagacatattactgactatgagcagggagccaggcctgcaacttccaaccgtgcaagtgtttgtttcattaatcagaaatcaagcctatgtcaagcactgtaataattctaagtcgactaattaataaaaaagaacgttagaacttacatttgatcttccgttagatgattttggggagggtttaagaaaggcagggcatgggggctcttgcatgtaatcccagcactttgggaggtggaggcggaaggactgcttgaggccaggagttcaagaccagacctggcaacatagttagacccccatctctac

SEQ ID NO: 316387 - DNA, 5670 bp, Homo sapiens
  misc_feature (1819)..(1821): n is a, c, g, or t
  misc_feature (1873)..(1874): n is a, c, g, or t
  misc_feature (1922)..(1923): n is a, c, g, or t
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaggggnnnccaaaaacactcaaaaaaaaagagaaagaaaaacccccccgggggggggggnnttttaaaaaccctttttttttttaaaaaaggggagattttttgggggnnttttttggcccccccttccctggggggggaacaaatgtagtatttttaattattggggggggggggaccccccccaaaatttttttttaggcccccctttttaaaaaccccccataattttgtgcggcggggaaatgttttttatttttgggggcccccttctctaagggatgggaattgtcacggtatgatgagtgggtgaaggctgacaggataatctggcctttggacaaaggtggaccaaagaaaaaacagaagaaaaaagctaaaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316388 - DNA, 3558 bp, Homo sapiens
tagccggtccgagatctccttcactgctctttagagaatcaccttggttgattctcttaggcagacagaataaagctttgaaataaagaagatagtgaagtggacgaaaagagagatgaggagaggcagaagtcaaaacggggacgacctcctttaaaatcaaccctctcatcaaacatgccgtatggcttatctaagacagcaaacagtgaaggaaaatcagactcttgttcatctgatagtgaaacagaagatgctttagaaaagaatttaataaatgaagaactttctcttaaagatgaactagaaaaaaatgaaaatttgaatgatgataagctagatgaagaaaatccaaagatttctgcacatatattaaaagaaaatgataggactcaaatgcagcctttagaaaccctgaagttagaagttggagagaatgaacaaatagtacagatttttgggaacaaaatggaaaaaacagaagaagttaagaaagaagccgaaaaatctccaaaaggaaagggaagacgaagcaagacaaaagatctttctttagaaattataaagatttcatcatttggccagaatgaagcaggaagtgaacctcatatagaagctcatagtcttgaattgtcttcattagacaataaaaacttttcttctgctacagaagatgaaattgaccaatgtgtgaaagaaaagaagttgaaacggaaaatactaggacaatcatcgccagagaaaaaaataagaattgagaatggaatggaaatgacaaatactgtatctcaagaaaggaccagtgattgtattggatctgagggaatgaaaaacttaaattttgaacagcactttgaaagagaaaatgaaggaatgccatcattgatagcagagtcaaaccaatgcatccaacaactgactagtgaaagatttgatagtccagctgaagaaactgtaaatattccactaaaagaagatgaggatgcaatgcctctgatcgggcctgaaaccttggtttgccatgaagtagatttggatgatttggatgaaaaggataagaccagcattgaggatgtagcagttgaaagctctgagtctaactctcttgtttctattccacctgccctacctcctgtagtccaacataacttttcagtagcttcaccacttactcttagtcaagatgagtctcgaagcgtaaaaagtgagagtgatataacgattgaagttgatagtattgctgaagaatctcaagaaggtctctgtgagagggaatcggcaaatggatttgaaactaatgttgcctctggtacctgtagtataattgtacaagagagagagagcagagagaagggtcagaagaggccaagtgatggaaatagtggattaatggcaaaaaagcaaaagcgtaccccaaagcgaacaagtgctgcagccaaaaatgaaaagaatggaacaggacaaagcagtgatagtgaagatcttcctgtcctagacaattcaagtaaatgtaccccagtaaagcatcttaatgtatctaagccacagaaacttgcacgatctcctgcaagaatatccccgcacatcaaagatggagagaaagataaacacagagaaaaacatccgaattcatcccctaggacatataaatggagctttcagctcaatgaattagataatatgaacagtacagagagaatctcatttctccaagaaaaactacaggaaatcagaaaatattatatgtctttgaagtctgaagttgcaaccatagacaggaggagaaaaagattaaaaaagaaagacagggaagtgtctcatgcgggagcctccatgtcatctgcttcatcagacactggaatgagtccctcatcatcgtctcccccacaaaatgtacttgctgtagaatgtaggtgataaacattttctctaccttcccagcagtttgctgccatggacataaatccccaaaccctgaattacaaccacagaaagcactcaactggtttgacattgctaagtatatcctgtatacttttccaggctggattgtatctattcccctctctcttcttttttcttgttgcaaaaaataagctgattaataagtgaaggttaagcagcctgccatatttgtcataatttttcctctttacttttgtttttcgtttgttgtgatatagaacaaagggcacttagcaaatttgaatttgtataataaagctttcaggtgttacagaaatcgtagacaagcaagtgcacatgataaacatcaaaatattacccagctgaatagttactgctgcactttcactaagatgtatttgaacacttggtgagtagggggtttatgttgtgttttttttcattatcgttttttttatttttgtggaagcacttgctatttagaactgccaaagtatatgttcagcagtgtgcccaggattgaaggtgtaaatgggacaaaataaattgtgaaaggaagtgtagttgactgaaaactacagttgtaataagtcttccactttttataggatttttgagcacacaattatgcaaatattttaatgtttattaatgtttacagtggaattgtgaataagttttcagtggactatcttatcccttgacaaaaatattttgtcttttttctatgtaatttcagagtttttattttgttacaaaaagacaaaaatgaaatatataacaacaatgaagttatttaacaagatttctaaagctgaaatttttgtgtaaaataaggtattatcttgcaacttgttaaatatatttattcagacattggatgttgtatttttatgtattttttaaaatattaataaaatttaaaaaaagaaaattctaggttaattcactctttggatgacaatagctctcagctgtcctttttacaggaggttgcatcctgcagccttgcctgtgttaaagggagtctgtctcagtccatcaaacagtatagaactataaatgggcatctggatcattaaagtatgtccttgtttagaaactttggcagtcctagtatttaaactgttttgaggatcaaatttttggttgcccttaagatactttgtcacagtttttatgtttgctatactgccgaatgaatttatatctcccaaagttgagatgcaacaactaagtaaagcaactatgtatgctttgtctgtgaattgttccacagactgatagattttgtaaataattcttccaaaatcatgtatttaaagcagttttgcatatacattatgtaaaaaggtgattttataaaagcagtttttaaattcatgtttgtacattgaaaggggttttttttttaaacctccttttctgtgtttaatatgctgtagaataataacctagatgctctagactgtatatcaggatctgatttacaagaaaaagtcagagctaaacactagtgatggcatagcattactgaaatcattgtttcttaatttcattttactacattgtgaacttgtgattcagattccattttctcagagaattaaaaacaaaaaaagtactcttgta

SEQ ID NO: 316389 - DNA, 2103 bp, Homo sapiens
aacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaatgaaggcggcagatgagcctgcctacctgacagtgggaaccgatgtcagtgccaagtaccgaggtgccttctgtgaggcaaagattaagactgtgaaaaggctggtgaaagttaaggtactcctgaaacaggataataccacacaattggtacaagatgaccaagtaaagggtcctttaagagttggagctattgttgaaacaaggacatctgatggatcttttcaggaagctattatcagcaagttgacagatgctagttggtataccgtggtgtttgatgatggtgatgagcgaacattgagacgtacctcactttgtctgaaaggagagagacattttgcagagagtgagacacttgaccagcttccattaacaaatccagagcattttggaactccagtaattgcaaagaagacgaacagaggaaggagatcttctcttcctgttactgaagatgaaaaggaagaagaaagcagtgaagaggaagatgaagacaagcgccgtctcaatgatgaattactaggaaaagttgtaagtgtggtgtctgcaacggagaggactgaatggtatcctgctttggtaatatctcccagctgtaatgatgacatcacagtgaaaaaggatcagtgtttagttcgatcatttattgattctaaattttactctatagcaagaaaggacattaaggaagtagacattctcaatctaccggaatctgagctctccactaaaccagggcttcagaaagcaagcatcttcttaaaaactagagttgttcctgataattggaaaatggatataagtgaaatccttgagtcatccagtagtgatgatgaagatggcccagctgaagaaaatgatgaagagaaggaaaaggaggccaaaaagacagaagaagaggtgcctgaggaagaacttgatcctgaagagagggacaacttcctccagcagctttataagtttatggaagacagaggtactccaatcaacaaaccacctgttttgggctataaagatctcaatctcttcaaactcttcagactggtttatcatcagggtggatgtgacaatattgatagtggtgctgtatggaagcaaatttatatggaccttggcattcctattttgaattcagctgcttcctacaatgtaaaaactgcttatagaaagtatctctatggttttgaggagtactgccgttcggcaaatattcagttcagaactgttcatcaccatgaaccaaaagtaaaagaggaaaaaaaagacttagaagaatcaatggaagaggctctcaaattagatcaagaaatgcctttaacagaagtgaagagtgaacctgaggaaaatatcgattcaaacagtgaaagtgaaagagaagagatagaattaaaatctccgaggggacgaaggagaattgctcgagatgtaaattctattaaaaaggaaattgaagaagagaaaacagaagacaaattaaaagataatgatacagaaaataaggatgtagatgatgactatgaaactgcagagaaaaaagaaaatgagctactactggggagaaaaaatacaccaaagcaaaaagagaagaaaattaaaaaacaggaggattctgacaaagactcagatgaagaggaagagaaaagccaagagagggaagaaactgaaagcaaatgtgactctgaaggagaggaagatgaggaagacatggaaccctgcctaacaggaaccaaagtgaaagtaaaatatggacgagggaagactcagtatcacactatatacctctgtgacatacctgcacctatcccctaattctattataaaagttggccaaaaagaaaagtaatgcattttcttcccttgacgatatttagtgcattt

SEQ ID NO: 316390 - DNA, 918 bp, Homo sapiens
ccccttctttcaccccaatcgggcataggatctagggccctgtgggtgttaattggacgaggtctctctactctacccagcttgcgctccccagccgcaagtcggccgcgctttgcccgtcagcgcttggagctttctgcgtcgcttcccgctgcgcctgcgcggtcccgcctcgccccacgcgcgggctcgcgcttcggtttccccagacctgctcgcagcaccctgctgtcttcccggtccggcccgctgcccgcggcgccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 316391 - DNA, 334 bp, Homo sapiens
tacccctaggctggagttaggtccggagtttttatcttcatctttagtactgtactgtttctcaggttcattgaggaggcactgagaacaaatgggatattttttccatgatgagggaaaaaaccccaaccctgagagagattcagtgaggatagcgggagacggaaaagttagacctcagagcacttctctgccagctcttctattcttttttcaagtcccttgtgggcaaggatgtggtcgtggaactaaagaatgacctgagagtcttgccctgtcgcccaggctggattacaggcatgcgccacaacgcctggctcattttttgtatctt

SEQ ID NO: 316392 - DNA, 843 bp, Homo sapiens
tacccctaggctggagttaggtccggagtttttatcttcatctttagtactgtactgtttctcaggttcattgaggaggcactgagaacaaatgggatattttttccatgatgagggaaaaaaccccaaccctgagagagattcagtgaggatagcgggagacggaaaagttagacctcagagcacttctctgccagctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 316393 - DNA, 790 bp, Homo sapiens
tacccctaggctggagttaggtccggagtttttatcttcatctttagtactgtactgtttctcaggttcattgaggaggcactgagaacaaatgggatattttttccatgatgagggaaaaaaccccaaccctgagagagattcagtgaggatagcgggagacggtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 316394 - DNA, 850 bp, Homo sapiens
ccccttctttcaccccaatcgggcataggatctagggccctgtgggtgttaattggacgaggtctctctactctacccagcttgcgctccccagccgcaagtcggccgcgctttgcccgtcagcgcttggagctttctgcgtcgcttcccgctgcgcctgcgcggtcccgcctcgccccacgcgcgggctcgcgcttcggtttccccagacctgctcgcagcaccctgctgtcttcccggtccggcccgctgcccgcggcgccagcaccatgcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 316395 - DNA, 897 bp, Homo sapiens
ccccttctttcaccccaatcgggcataggatctagggccctgtgggtgttaattggacgaggtctctctactctacccagcttgcgctccccagccgcaagtcggccgcgctttgcccgtcagcgcttggagctttctgcgtcgcttcccgctgcgcctgcgcggtcccgcctcgccccacgcgcgggctcgcgcttcggtttccccagacctgctcgcagcaccctgctgtcttcccggtccggcccgctgcccgcggcgccagcaccatgtcccttgtgggcaaggatgtggtcgtggaactaaagaatgacctgagcatctgtggaaccctccattctgtggatcagtatctcaacatcaaactaactgacatcagtgtcacagaccctgagaaataccctcacatgttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaa

SEQ ID NO: 316396 - DNA, 3569 bp, Homo sapiens
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccc

SEQ ID NO: 316397 - DNA, 697 bp, Homo sapiens
  misc_feature (683)..(683): n is a, c, g, or t
  misc_feature (697)..(697): n is a, c, g, or t
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggccagggaattgaagccttgggnccccccctttttgn

SEQ ID NO: 316398 - DNA, 3599 bp, Homo sapiens
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctcccaaaaaaaaaaacccccaaaaagggcggccg

SEQ ID NO: 316399 - DNA, 3539 bp, Homo sapiens
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgagggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccc

SEQ ID NO: 316400 - DNA, 4340 bp, Homo sapiens
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctcccaaaaaaaaaaaaaaaaaaaaaaaaaaaaaaaaaaaaaaaaaaaaaaaaaaaaaaaaagagggggggggcgccgccctaagaatccccccgcggggggcgcccccatccccggcgcccccccttttgtgtgtgacagggggggcccccaaagggggggcgcaagcaaacaaaacacccagagacgggaccgcggccccgcgcgcctaacaaacacacagacccgagacgcggggaaaacagcgcgccacgcccggggccccttcggggaaaagagcccccaccaccagcgggcggggggggccaccaatggtggcgcaccaaccccacctcacgccagatcgatatataccgccccctgccggagacaactataacaaaccctccagcggcgatcaccgtgcggcgcacccccccgccgcgccaataacttgccgtggccgccgcaaaacatggcggccccaccccgcggcactgtcgtctcccggccacacttatccagccggccgcggcggcaagtaaagaacaccccgccgcccccgcccgccgccccgagcagaccgcgacgcccccccgccgaccaccgcccccgcccgcgcagcaggggcgcaggcccctacgcccgcccactcaccctcgacgccacccgaccacaccgccgcccgcacgctccgctggatccagccccgccaccaccacacccccccgacacgcccgcccccgcccgccgccccgcccacacacccacacgcccaccccccgcacccacccccc

SEQ ID NO: 316401 - DNA, 1775 bp, Homo sapiens
gactcagacgagtagctttccttatccagacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccc

SEQ ID NO: 316402 - DNA, 2595 bp, Homo sapiens
acaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacattttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtgagtggccttcctcccccggcaggatctggctgagctccttccgtgggcaccttggggaggccacaataggctagtaggcaaagcaggagtcctgccctggttgctctca

SEQ ID NO: 316403 - DNA, 491 bp, Homo sapiens
agtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagtgtaagaaacttcacctctcatgcccctctccgccccccagctccttattctctgtcagaccttattcttggaggcggcaactcactatcccctcttcctccccgcccccaggctccctgccttaggtctagcctgttacctctgaactccccaagcagcattaattttacttatttttttttagtcaaataattgtatgacactatgtactactaattttctaaatgctttgctcatattaatttcttgcaat

SEQ ID NO: 316404 - DNA, 3045 bp, Homo sapiens
gcatcaagaccatcagacatttaggagaaacagcggtgtctgcggctcccacccttcggggggcccgtggggggggcggtgtcaggggcatggacgccaccccccaggggtctctgctgccggctactctcctctccacgtgctcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggtgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaattggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcatgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggtacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaag

SEQ ID NO: 316405 - DNA, 376 bp, Homo sapiens
aaaaaaggtgaaaggatagaaagtagcaggtatgtacagtgaacaaatctgaagaactaatgtacagcagagggactatagttaataaaaatgtattgtatgcagtattcaggatttttgctaaacgtgtggattatctctgctcttgcagcagggcttgggtagctatgggaaatgatgggtatattaatatgtttcactataatcatcattttactatctagattatgtacctcataatgttgtataccttaaaataaaatttgttttaaaaatacacatatagtagttcagttttatattggaatctgatttatttattgaaaaggcttcacttagatgctgtacaggtttttttttttcttcttctttataa

SEQ ID NO: 316406 - DNA, 389 bp, Homo sapiens
cagcattgcttaatgtgacctcaggactgatcatcatatgctttttgcctgtgtaggtgttctaagcgttgtataatcacttaagaatggacttcattaaatagacaaaatatgagagccattacactatttttggtattaagtctttgaaatccagactgttttacacttgcaacacatacacttggggctaatcacatttcaggtgctcagtagcaacatgtgactaacagctaccaaatgaacagtgcagttctagtgcactgtttttaaaaaaattagatttttttttaaaattagatttctctagctgaatagttgtagtttcagataaacagccaaaaatgttctgtctctccacagcttcatctcaattgtgaagaaattgc

SEQ ID NO: 316407 - DNA, 477 bp, Homo sapiens
gaagcaatcagcaaaactcagaatatggaaaattctacagggcagatgactaacttaaagagattgtaaaaccttcagtaagcaaatacagggtgtagaccacgtccggaatcttaaatgagcaaaccaatagtaaaaatcatgaatgaaataactagggaaatgtgaacattggacatttgatatcaaggaattattgttagtttcttaggcatgaggatggtattacatttatatctatttgttaaaagatactttattttttagagattcctatttaagtcatttctgatgaactaacagcatgtcagggatttgcatctaaacagtggctgggagagagggaagcatacagaggcagctacaccccaagactcatcataagctgggaactgttgaagcagatgatgagtacatgggggttcattttactcccccatgctctcagtatatgttttaaaatttcccaaagttagg

SEQ ID NO: 316408 - DNA, 2343 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316409 - DNA, 1121 bp, Homo sapiens
  misc_feature (1013)..(1013): n is a, c, g, or t
  misc_feature (1016)..(1016): n is a, c, g, or t
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttctgggnganccgccctgtgggtattaatcctaacagtgtgggcgagaaaggcctctgaacggcgcaaacacattttgcggctgtctccacggccaaccgagggggaaaatcttc

SEQ ID NO: 316410 - DNA, 378 bp, Homo sapiens
tgttagctttgtttgtgtttcccccctccccttttccctgattttcttttcagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagctgaggcaggagaatcacttgaccccaggaggcagaggttgcagtgagccaatatcgcccactacactccagcctggccgacagagggagactccatccaaaaa

SEQ ID NO: 316411 - DNA, 2782 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316412 - DNA, 2103 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316413 - DNA, 3479 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaaaaaaaaaaaaaaaaaaaaaaaaaaaaaaaaaaaaaaaaaaaaaaaaaaaaaaaaaaaaaaaaaaaaaaaaaaagggggggggggggaaaaaacagggggggaaaacattaaaaaaggggcccaaaggattaacgaaaagggggggtaaatggcggtgggacaaacccggacacgtgggcagttgtggggagaggaccccacctgtggggcggggcaagcaggaaaacatccaccaccaagaaataaaagaactccgggcactacaaaacacaggtggtggtggatgcaaaccaccacattagctggcgcgcgaatgcctgcgtttctttgctactgcaacgggcctagctacatcatccggggaaccaggctgaggagaagaacggcgacagggaagcgtagcaacgaagcacacaacggaggaggcgtgcggacagaaactaataggcgaatgacaggaacacataactgttcacc

SEQ ID NO: 316414 - DNA, 3387 bp, Homo sapiens
  misc_feature (3158)..(3158): n is a, c, g, or t
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaaaaaaaaaaaaaaaaaaaaaaaaaaaaaaaaaaaaatttggggggggctggggccctgagaaaaagagtttctcaaaaacaaaatccggttggggcgcgcgggggcgcccaagtagggtaacggcagaacacatggcgcccataaagcgttggttcnaccaaaggaagaacccggggtcaaatggacaaaagtggcctgggggatatttcccaccataataaaaaaaagagcgccgcgggggggacacaccgaaggcgttcgggaaacacaattcccaaagaggggatttcgcggagaggtcactatagacggggaatcattctaacacgagaggagttccaacagggaaacctcaaaaatcaaatatagagccccgactcgggga

SEQ ID NO: 316415 - DNA, 1050 bp, Homo sapiens
ccgactctagaggaccccgctattccatcggcactcgctattcatcggcacctcgctattcatcggcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316416 - DNA, 1864 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtccta

SEQ ID NO: 316417 - DNA, 3002 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316418 - DNA, 2816 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316419 - DNA, 2309 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 316420 - DNA, 3742 bp, Homo sapiens
gcgcttcggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaaacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagggcaagctctgtgtgattgattggaagacatcagagaaaccaaagccttttattcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagttgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaaaaaaaaaaaaaaaaaaaaaaaaaaaaaaaaaaaaaaaaaaaaaaaaaaaaaaaaacaaaaaaaaaaaaaaaaaaaaaaaaaaacaaaaaaaaaaaaaacaaacacaaaaaaaaaaaagcacccaaaaaaacaaaacccggcccccccgcccccaaaaccggtgggggacacccggccttgacgaaaacaaacactcagcgcggagccgcagccggccacacacgaggggcgatacaaccatccgggttgtgctaagggccgtcctacaaacaaaataaacccgcccggccgcggcgacagcaactactaaatcatcgcacacagcccatctcaccaccgtactcgctcgacattgcccgacgaaggcactgcattctcaacctcaccacgctgccaggccacgactcgacacacaacgacacgtgttggggatgggtgttcttgtaggtctgggtagtcgtggcgggtggacggcacaggtgttgtcgtcggcgctagtgagggttgagcgggtgtttcgggtgtggggcaggtgtgagtgtagttgagtgtcgaggggtaggcgcttcgggagggtgcgtgacttgtgagttagcgcgagtgtgtgagaaggtgttgtgtagtgctgcggtagagtaatgtgaggctaacaggtcggacggcggagtagtggcacacacacggaagtgaagagaaggcgtgacgatcagttgaatcagttgaagtgaaacgtacgaggt

SEQ ID NO: 316421 - DNA, 1935 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316422 - DNA, 846 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaagagtaagtgcgggattgagcccgttgcgggcccagataacgggagaacaacgttcgaatgaacccaccaaaggaggagaacccagggctgtggggacccggttccgataaccttgtgagggagaacaaactgaggcgaggcacacagaacactcgacaagcacaggagtagagaaatcacaccagttgctagtggcgcgcatt

SEQ ID NO: 316423 - DNA, 2378 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataacttgttttctagaagtcatttgggggtggttgttccctttggtggcttttttccccccgtctttgagttgaacactattgatgagagtaagcattccaaaggataaattacaggacactaaaacaggtcatgatgagcttaagcggagagcaggatttaacataattggcataatgcttcattgttatcattgtaacatgcctcttggtgtgctttaatcaaaagctgcaaagttgtcactgcttttttttttttcttaattgccatcatatcaagtgtactccagagttagaaaggtttgcaatactcaacattatctttttcaatgggcaggaggcaaaaaaaatcaagtgtttctgtttatacctgattcaactacttaaatagaggtagattggaataatacactgattgattgatgggtggcattaaatataaatct

SEQ ID NO: 316424 - DNA, 1778 bp, Homo sapiens
caaagggggtgtgggctcgggtccccccgcccgatcgcaggggaaggggctgtttgtgcagcgtccggctgtgttatgagtggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316425 - DNA, 1919 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagattggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316426 - DNA, 911 bp, Homo sapiens
atccagctcggacccactttcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316427 - DNA, 1542 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcagtaatatctgcccttcaaagttcatgcaaccaactaatgtcgacgcggccgcgaatttagtagtagta

SEQ ID NO: 316428 - DNA, 744 bp, Homo sapiens
agagagagagagagagagagagagagagagagagagagagagagagagagagagagagagagagagagagagtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316429 - DNA, 1764 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316430 - DNA, 1957 bp, Homo sapiens
caaagggggtgtgggctcgggtccccccgcccgatcgcaggggaaggggctgtttgtgcagcgtccggctgtgttatgagtggtagctcttccgtggtggctagcccgggtgcacaggctgttagtgggatcttgggggtggtggttcgcagccgacgtgcgcccgggaatcctggggggcagaggcgagcaaaagtggggtgcgctgtggtgggcgacacgtgtggcgcgggtctcattatctgcccttttcacttccaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316431 - DNA, 1891 bp, Homo sapiens
agcggagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaagttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaata

SEQ ID NO: 316432 - DNA, 450 bp, Homo sapiens
agccaacttatcccaccttctgcctgttttgttctagccacactggcagctgttagatggtgtccacccacattgagggtgggtctgccactcacagtccacggactcaaattttaatctcctctggcaacaccctcacagacacacccaggaacaagtttaccagctatctaggcatccttcaatctgatcaggttgatatattaacatcacaagtccttgtcaacttgaaccccttgtcaacttgaacccatacacatctcctgaaatcatatttaatctccaaataaaggaaataataaggtcataattacacctaacgtaatacagctatccttcatacaaccagaagcacactaatccttaacctaaatgctattacataaagttaacaacatttaaatgctgatataaaatcaataaatcttatgtcacatgataatggaaaaa

SEQ ID NO: 316433 - DNA, 397 bp, Homo sapiens
  misc_feature (68)..(68): n is a, c, g, or t
  misc_feature (116)..(116): n is a, c, g, or t
tcagctcagacatcctgtctggtcatttgttgttgcgcagcctctgcttatcacaggggaataaggantactcatccctaactgcttattgacttctatcccgtgttagagctgtntggaagtctctgagttataacggcctaatagtttgatattggtccttgaagcagttcaatctctgaattggctcagcagttctgttttacagctgcaactctctgggccagtaaaaaaaagacagatttctaatttttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316434 - DNA, 752 bp, Homo sapiens
ccaaaggccagtggaaggagctcaggcttggcggcatctggtttgcttgtctgggcctactcctttgcatgatataacaaatggcagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggacggagtctcactctgttgcccaggctagagtacagtggtgcaatcctaactcactgtagccttgacctcctggcctcaagcaatcctcctgcctcaacctcccgagtatctgggactacaagtgctcaccaccacgcccagctaatttttttgtagagacatttggctgtgttgcctaggctggtctcaaacccctggcctcaagtgatcctcccacctcagcctcccagagttgagattataggcatgagccaccaccatacctaacctgagttggtttttttatatgtaaaatgctgatgataataaaatatgtccttgactcta

SEQ ID NO: 316435 - DNA, 650 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccaggtaccgcgcccttggcgcccggcgcggcctcagcggatgcgcgtccctctctccggacaggcct

SEQ ID NO: 316436 - DNA, 2674 bp, Homo sapiens
ccaaaggccagtggaaggagctcaggcttggcggcatctggtttgcttgtctgggcctactcctttgcatgatataacaaatggcagggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316437 - DNA, 3806 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgataaaaaaaaaacacaaacaaaaaaacaaaaacaaccacaacacaaccacaaacaacaaccaaaacaacaaaccaaaaaacaaacaccaaaccacacccacaacacccatcccccccccccccccccccccccaccccaccgccaccccacccc

SEQ ID NO: 316438 - DNA, 3676 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgataatgttgaatgatattatctgg

SEQ ID NO: 316439 - DNA, 3062 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattctaatttaaactattttgtactgatgtagccctgaggtagttcatgaaaatgctgtgcactcattccatggaataaatgttggaaagctgatcttttctgatataaaatgttgaatgata

SEQ ID NO: 316440 - DNA, 854 bp, Homo sapiens
atcatatagaaaatgaaatgaagttttttgttgttttttttttttttttttttttttttgacacagagtcttgctctgtcacctaggctggagtgcagtggcgctatcttggctcactgcaacctccgcctcccgagttcaaaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316441 - DNA, 2640 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagccttttcaatactggacagcatccgtaccgcatgccgcgcggggatcctctag

SEQ ID NO: 316442 - DNA, 676 bp, Homo sapiens
  misc_feature (36)..(36): n is a, c, g, or t
ccaatcatcccttcttgctcctctttgtgcacgtanacaaaaaaaaaaaaaaaaaaaaaaacacacccctgctcaacagaggtttagtttacagtctctgaactaaagtagtaaccctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316443 - DNA, 2392 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316444 - DNA, 2175 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316445 - DNA, 1801 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggtgagcatcagcatcacctgccttcctcactagctgtggctgcttccacattgcttgaaacagggcttctttttctttttcttctttctttttgagatagggtctccctctgttgaacaggctggaaagtgtagtgtgtgatcatcgtgtactatggcctggaactcttggcctcaagtgatcctcttgcctcagccttcagagtagctggcactacaggcacgcaccaccacaccctgcacagaacttcttgagagccaaaatattgaagctaaagtccagcttaagactggaattcccaaatagatttagtttctagagttgtcctgttatttctccttgtttctctgcccattttcctttaccttttgaaaatgttaaatcctacaccaaagtc

SEQ ID NO: 316446 - DNA, 1733 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggacggagtctcactctgttgcccaggctagagtacagtggtgcaatcctaactcactgtagccttgacctcctggcctcaagcaatcctcctgcctcaacctcccgagtatctgggactacaagtgctcaccaccacgcccagctaatttttttgtagagacatttggctgtgttgcctaggctggtctcaaacccctggcctcaagtgatcctcccacctcagcctcccagagttgagattataggcatgagccaccaccatacctaacctgagttggtttttttatatgtaaaatgctgatgataataaaatatgtccttgactcta

SEQ ID NO: 316447 - DNA, 494 bp, Homo sapiens
  misc_feature (36)..(36): n is a, c, g, or t
  misc_feature (90)..(90): n is a, c, g, or t
acaggaaaacaagcctatgaccccatgaattgacgncccaagcctcgaaattaaccccctcacctaaagggaaacaaaaagcctggaagnctccccaccgcggtggcggcccgcctcctagaacctagtggatccccccgggcctgccaggaattcggcaccgagatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316448 - DNA, 3655 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316449 - DNA, 4703 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagaggtaactaactggcctctgtaggaaggtgggaccgaagagctcagggagcctggtaaggccgtggggccggttctgaaggtaaggacttctaagggtgaggccagctggctggagggcttgtgagatgaccagcacacttgtgtgccaagcgcttttacacacaccctctcgatggaagctcaccattcctctctgaagaaaccgattccctaagaggtgtagggcatgattccagggcatacagtctgcatttagttctcgttactgggtgctcaatgcctgcctgtatgtgctgagtgtattctctgatttggccctcacagcagctgttttttagaagaaactgcacagagaaggtaaatgacttgtccaaggtcacacatctactcagttgtttgagccaggaccacactcctctttgtgaagctgggcaatagaaccatctgttctgtcccacccctggggaattccagctccctgcctcttccacatctgctattgaagcacatcctccagccttttcctctctctctccacatcatcagcccttctggatctttctcatttgcatacaaatgtgctattattttcccttccctggatgtgtctgtttctttcattgctttccttcctttacagcaaaaacttcaaaagaattgtgtgtcctttctgcctccaattcctctcctcccattctctcctaaacccactcctttctggcatttgtccctctatgcctctgagcctgaccttgccagggtggccaatgtcttccgtatcgcggaatccagtggtcagctcttacgctcctcttaacttcaacacagctgattcccctacaggacgcatctttctctggcttccaggacaccacacttcatggtgttccttctacctccctggtacgtccctctcaggcatcttgtctgtgttggtagcccagactcaagttccagccctgtcacccccagactgctctgtttctggccccaggcctggcgttcatggcggctgaactcatggtctttcctgtccccttcttttccagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316450 - DNA, 3968 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttcctttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgataaaaaaaacgcgagcaaaacaacacatgatttgtgacgcatggcacaaaacaagacagtaaaaaccgaactgttgggcagcgctagacccaatgaagagtaacgaggccaacacaggtaccaaggaaccccgggcaagaccaagtgttgggactccccaaaaaaagcccgggggacgcagatctacaaatcgaagggcggcgacagcgactgcacgagaaggacgaataatgccgccagcgaagaggcaacacgaagacaaagacagagggactaacgagaggcgaacccacgacagacaacagaaaacaacaa

SEQ ID NO: 316451 - DNA, 2641 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatctggcaaagggaaactcgctcctggctttgatgctgagctgattgtgaagaatatgttccacctttctatcccatagaacactcttttttatcttccctgaaccatattgatgagataaatagggctgggggctgggccccgctggtcactcaacagagtatttcccttggccgagatggaagttttgtcccaatagatgagctgctgagtatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316452 - DNA, 2595 bp, Homo sapiens
  misc_feature (2552)..(2552): n is a, c, g, or t
  misc_feature (2564)..(2564): n is a, c, g, or t
  misc_feature (2574)..(2576): n is a, c, g, or t
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagccnggccgcccccancgcgcccgcnnnagatcctctagagtaccta

SEQ ID NO: 316453 - DNA, 2051 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgactgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgata

SEQ ID NO: 316454 - DNA, 1760 bp, Homo sapiens
ttctcttccgactttgggccaaagccttgtccggagatcacagtgtctcgctcggggacacgccctctctaggcccagacttggtccccactggagttcccagcccccctccccgctgcggcacgcacattcccaatgccgggcggggcagggcgcagcaggcccgccctcggcgcgcggccaggctgggctcctcccctggagctgcggccgggagggcgggcggccggggagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagaggcggagaaactccatctatccatccatcaaagatttattgagtttcttcatgaccaggccctgctcacggtgttagggattcagcagaaagaaacacaaacaaaacttcctacgcacacagagagtgtttccttgttgacgccctcaataatgtgtgtgcctcagaggttatcaggcacctgggagactgactcacgttaacttcctagaagctgacatactcacctgatgctacatggttccttgactgggtgtgaatcgacctctacactggttggaattcttgtgcctggaatcctcggggcctgagaggctgagttcatttgactgctgacatcagatcccagggatgtggg

SEQ ID NO: 316455 - DNA, 4120 bp, Homo sapiens
  misc_feature (3049)..(3049): n is a, c, g, or t
  misc_feature (3061)..(3061): n is a, c, g, or t
  misc_feature (3076)..(3076): n is a, c, g, or t
  misc_feature (3084)..(3085): n is a, c, g, or t
  misc_feature (3089)..(3089): n is a, c, g, or t
  misc_feature (3092)..(3092): n is a, c, g, or t
  misc_feature (3097)..(3098): n is a, c, g, or t
  misc_feature (3108)..(3108): n is a, c, g, or t
  misc_feature (3113)..(3113): n is a, c, g, or t
  misc_feature (3117)..(3117): n is a, c, g, or t
  misc_feature (3121)..(3121): n is a, c, g, or t
  misc_feature (3130)..(3130): n is a, c, g, or t
  misc_feature (3143)..(3143): n is a, c, g, or t
  misc_feature (3147)..(3147): n is a, c, g, or t
  misc_feature (3173)..(3173): n is a, c, g, or t
  misc_feature (3180)..(3180): n is a, c, g, or t
  misc_feature (3183)..(3184): n is a, c, g, or t
  misc_feature (3187)..(3187): n is a, c, g, or t
  misc_feature (3202)..(3203): n is a, c, g, or t
  misc_feature (3216)..(3216): n is a, c, g, or t
  misc_feature (3218)..(3218): n is a, c, g, or t
  misc_feature (3221)..(3221): n is a, c, g, or t
  misc_feature (3225)..(3225): n is a, c, g, or t
  misc_feature (3228)..(3228): n is a, c, g, or t
  misc_feature (3251)..(3251): n is a, c, g, or t
  misc_feature (3253)..(3254): n is a, c, g, or t
  misc_feature (3259)..(3261): n is a, c, g, or t
  misc_feature (3271)..(3271): n is a, c, g, or t
  misc_feature (3279)..(3282): n is a, c, g, or t
  misc_feature (3289)..(3289): n is a, c, g, or t
  misc_feature (3295)..(3295): n is a, c, g, or t
  misc_feature (3297)..(3298): n is a, c, g, or t
  misc_feature (3300)..(3300): n is a, c, g, or t
  misc_feature (3304)..(3304): n is a, c, g, or t
  misc_feature (3309)..(3309): n is a, c, g, or t
  misc_feature (3313)..(3313): n is a, c, g, or t
  misc_feature (3317)..(3317): n is a, c, g, or t
  misc_feature (3319)..(3320): n is a, c, g, or t
cggcagggagaaggtggatgaaggggccgccaggagggagctgaatggctttctcctggcctgtcctggcttgttgggcatggctcagtatcactcacagtgagagactgagccatgtttcccagccaagggtctctacgagcaggctaggaagatgctgcagtgagtccttctacctgtcttctccaaatgtactttcaagcctgctgggatggccctgcaaggcaggccaccatgcacagctttactcacagcccctggccaggactgccaaggctggcctcatgcagtgagtccggagggaagaccctaaagcttagagctggaagggcccagccctggcaccgactccctggggtgtggttcagggatgactgggacctgcccaaggccgcgcagtcctctgggaggaggcagggcttctaacacagtgcatttgggcttcaagttcatggctctttccagttctcagattacaggcagcaagcagccaagtaacagagaattcctatttccaagtagggaaattgaggccaaagcagattaaggttctcagctgaggtgatgctgtgagctgggggtgtggtctccagtgacccagatgtgaaccagagctgacccaggctgttggtgcccctggaatcctggagagaactctgccttcctattttctccttgtcccctgaggcgacttttcttgagtagatttcctagtggatttcaggagggcagggtaaaaacatgtttagaccacgagagaaaggggctgggaaagttcaggggtctttccatgtcagcacgcttggagcctgcacacctagaaaagaatatggctgcttcgagtgcagcaggaaggatgcaggttagacttaagcaggaacttccaggccttggagaatgtccacctggtaagaagttctccaagatccttttgcgggcttctcctagaggttattaaatattcccactcttgatataaaccctaactagtgtagtgatggcacattagagttgaccaggggctgcattagaaacatctcaccgtttcttcagcccagccctgccaggtgagtgggacagtgctgactgttttgcaggccagggacctgagccttaggagcatgagggggactttggattctagatgtttcttgcttctctgcccctgtatcctacccgctggagcacacggttggggtggacacttcctggaggcagaagagtggaggagatggccttctgagttctccttggcatcctgctttggatgtggtggcgaggaccgtccctgtcctcagctctattcctctgagttgttgtggccaagagagaatgcagagtctcactccttagccttgttctatctcctcttgggccttgttctgctccaagtatgaagtgttcagttctccagaggggcccgacctgggaaagtagagaaaccacgtggcctggggccctggcagggagccaagtcattccttgggcctggggccagcctgctgcagccaggagctcgggcatgtggaggaaggtccctgctgctggccaggctgggcatgcatgccatgtggtcgccttacacatgcaggcatggccagagagagggaagcagatggggttgaagtgggggctatacattccagctcagcagccgccaccctaagacccagggagctctggggtgactgctggaaatggctctgccacttagtagcggagggatgaggcaaggtatgggtgagggggtcttgggtgtgttctgggctgcagtctccccattggtgtaatgaggtggtgaacatcaagaacgtctcgggtcctttcatccttagaccatctgtgattgttccaatcagagatttgttccagcacctttaaagctcttttttccaaccactgtgctcttaattacaaaccctagattcctagaggtcatctgcttgacccctccattggaagggagattgaagatggagacaggggttgactcccggaggccctcagcgtgtccaagcagaaccagtcctcagcatcaatcatgccattcctttttgcacattagctcagggctctaatgagccctcggagagcctgtaggctggttctagttcatctgttcattcagtgtccagttgtagctaagagaacagcttctggagtcacactgcctaggttcgaatctcatctctgctatgccagggctgtgtgactttggaaacatttcctagcctttcagaatcacagtttcctcatctcaaaaattcagccaataatagggacctgttgggtggtcacgctgttggggtttactgttgctatgattgtttcatcccaccatcatcgccctctggctagactcaggctgcattttgtctgcagaggttactcccctccagaaactgactcaaaattctgatgaccgtctctcccttgcttatacctcagagacattccctcacatggctgaggcctcccatgtggcagtgaggcaccctcactgaggcacccttcatgtggcatctcagctcatcctcacagcactcccttttggatggcaaagagaactgaggccccaagaggcctgtgggtggtgcagtcaggactgtcttggggcaggctggccagcctggaatggcctctgaatgcagacccatgggtctgagacctgcctggcagctgctgtatgtgaatatattgggcatcacagggtcctaaaggatccttagagatcacacacctccaacctgagcaggacagagggtcaagtgtgggggcctgcccaaggtcagacagccagcctagaggagagccagggctcatctgcaggccatctccatatgctggacttggagaacagggcaggactacaagttctgtcccttgtaggccatgtggagtcagccaggtgcccagccagacaacattgcccttgtctcaaggagttgctttcctctcctaccaggttcttctaccccaaagttcagaggccagaggtgggaactcaatgccttcagaaggtgccctggctggacgccatggctcacanctgtaatcccancactttgggaggccnaggcaggnngatngcntgagnncaggagttcnagacnagcntggncaacatggngaaaccccatctntacnaaaaatacaaaaattagccaggtgtngtggtgngcnnctntaatcccagctactnnggaggctgaggcngnagnatcnctnggaggcagaggttgcagtgagcngnnatcannncactgcactncagcctgnnnnacagagngagacncnntntcangaaanaaanaaanannaatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgcattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggta

SEQ ID NO: 316456 - DNA, 1707 bp, Homo sapiens
ggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggtaaggcagcgactgggttccctgtgaacacagcactgacttacagtagatcagaactctgttcccagcataagatttgggggaacctggatgagtttttttttttgcatctttaataatttcttatatgttgtagagtatgttttaaaataaatttcaagtatttttttaaaaaactttcacagctaatatataagagcaaagtggacagctgcattcttttattcctctttgtaagtacaaccacttagcacagcacctgctgcctccttccctggttgagagaggtgagtcgggtatgggagcatcttgcagacaattcctgaccttcatttcttcctgttatatatacttattattatatatatattacttatgcccaatacttaaatctactt

SEQ ID NO: 316457 - DNA, 4670 bp, Homo sapiens
agcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgcattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtaaaaaaaaaaaaaaacacaacacaaacaacgttgtgtggcggactgaggcctgaaaaaggtttttagaccaaccctggtgggcccgcgggcccaagtgggtcatgtgaacctgtggccaacgcgtgctccacagagaactgcgcaacgacaggggggttggcttccccaataaaaaacgcggggacacgagcgttgtacaacctcaagggagctgaggggcacacggctctcaaggtcagggcaaata

SEQ ID NO: 316458 - DNA, 401 bp, Homo sapiens
tcttcattaattttatttttgtcttatgtctgtgatttttgacacctctgtcatctgtaagtaattaacatgtaagtaatttttacccatggaataatattttagaattttagaacagcactcaagaaactcagatgagacccaggaaactgcatgttttagacattggattaagtataactatattaattagaaggaggtgtcaaaactcagttttcaaataaatggagtaatttgacttattgtattgagatgagtttataacaataggaaacactagaattctgatgcagtaaattgctatttcatttagaagacctaaaattacggctgacatgcttctttgtagtagtgtttttctccccatcaaaaactttaagttcttttgaacgtgtgtgcag

SEQ ID NO: 316459 - DNA, 4423 bp, Homo sapiens
agcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgcattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggta

SEQ ID NO: 316460 - DNA, 3225 bp, Homo sapiens
agcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggcgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctc

SEQ ID NO: 316461 - DNA, 684 bp, Homo sapiens
ggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgcttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaaggaaaagtattgtttgtgaccattgctaaatcaattatcaatgaaaggaaagaaagaaaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcg

SEQ ID NO: 316462 - DNA, 950 bp, Homo sapiens
cacctcagtgctgctcataattgcagaggatggcctcaccagtcagggggtcctggagggcctgggggggcttggtctctgactgccagcaaaagacgctggtcacatctaggcagcaggaggcaaacactgagtcagctgacttgcctgactttaaccctcaggttttttaaaaaaattaaaatacaggtgcaggggcttgggctcgggactcctggacccacgtggggctgagcgtggatggtgtttggtgtccggcttcactcccaaaccgcacccggagggtttgcggggcggaggggcctcagggcgacggttccagaacagacccaggctgctccggtcagcagcagccccgccgctctcccacctagcggggacccccagccccgccagccgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgtgtgggggcggaggggacgcggtgggtgcggcctgggcgcgggtgggctagagcctggagaccgccgggagcccgacttcctggcgctttgccctttggggagcggagccaaggaacagcgccaacctctctccacaagccagggaccctacgacccaccgccgcaggtgagctccgcccgggcgccccctcccccaccacgcctggatccctgccgggctccccgagccgagactgtgccttctgcaacagggctgtgctccag

SEQ ID NO: 316463 - DNA, 945 bp, Homo sapiens
aatgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggag

SEQ ID NO: 316464 - DNA, 579 bp, Homo sapiens
atttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccag

SEQ ID NO: 316465 - DNA, 2490 bp, Homo sapiens
tgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316466 - DNA, 2351 bp, Homo sapiens
agctcaggcagtctgactctggtgcccctgctgtgaagagctgtgccctgctgcattcctcctgtagctgcacgaaagggcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316467 - DNA, 2325 bp, Homo sapiens
cccctgctgtgaagagctgtgccctgctgcattcctcctgtagctgcacgaaagcaccttggaagttgttttcaaccatatccagcctttgccgaatacatcctatctgccacacatccagcgtgaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa

SEQ ID NO: 316468 - DNA, 2310 bp, Homo sapiens
aatgtatgttcacaaatgagccacagccttatcagctggggttgagggaagactggtctaggtgctgctcctgaacttggtctctgagccatggcttcccatagacactcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactgggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacagaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataa
